United States Patent
Igawa et al.

(10) Patent No.: US 12,030,955 B2
(45) Date of Patent: Jul. 9, 2024

(54) POLYPEPTIDE INCLUDING ANTIGEN-BINDING DOMAIN AND CARRYING SECTION

(71) Applicant: Chugai Seiyaku Kabushiki Kaisha, Tokyo (JP)

(72) Inventors: Tomoyuki Igawa, Shizuoka (JP); Hiroyuki Ishikawa, Shizuoka (JP); Naoka Hironiwa, Shizuoka (JP); Tatsuya Kawa, Shizuoka (JP)

(73) Assignee: Chugai Seiyaku Kabushiki Kaisha, Tokyo (JP)

( * ) Notice: Subject to any disclaimer, the term of this patent is extended or adjusted under 35 U.S.C. 154(b) by 151 days.

(21) Appl. No.: 16/767,085

(22) PCT Filed: Nov. 28, 2018

(86) PCT No.: PCT/JP2018/043664
§ 371 (c)(1),
(2) Date: May 26, 2020

(87) PCT Pub. No.: WO2019/107380
PCT Pub. Date: Jun. 6, 2019

(65) Prior Publication Data
US 2020/0369781 A1    Nov. 26, 2020

(30) Foreign Application Priority Data

Nov. 28, 2017  (JP) ................... 2017-227650
May 30, 2018   (JP) ................... 2018-103682

(51) Int. Cl.
C07K 16/28  (2006.01)
C07K 16/30  (2006.01)
C07K 16/32  (2006.01)

(52) U.S. Cl.
CPC ........ *C07K 16/303* (2013.01); *C07K 16/2809* (2013.01); *C07K 16/2866* (2013.01); *C07K 16/32* (2013.01); *C07K 2317/31* (2013.01); *C07K 2317/515* (2013.01); *C07K 2317/52* (2013.01); *C07K 2317/569* (2013.01)

(58) Field of Classification Search
None
See application file for complete search history.

(56) References Cited

U.S. PATENT DOCUMENTS

| | | | |
|---|---|---|---|
| 7,901,684 B2 | 3/2011 | Gill et al. | |
| 10,357,571 B2 | 7/2019 | Williams et al. | |
| 10,568,977 B2 | 2/2020 | Desnoyers et al. | |
| 11,168,139 B2 * | 11/2021 | Igawa | A61P 35/00 |
| 2003/0235589 A1 | 12/2003 | Demopulos et al. | |
| 2004/0259768 A1 | 12/2004 | Lauermann | |
| 2007/0065878 A1 | 3/2007 | Daugherty et al. | |
| 2007/0099246 A1 | 5/2007 | Sandy et al. | |
| 2007/0243589 A1 | 10/2007 | Gill et al. | |
| 2010/0189651 A1 | 7/2010 | Stagliano et al. | |
| 2011/0064666 A1 | 3/2011 | Ogawa et al. | |
| 2012/0149061 A1 | 6/2012 | Stagliano et al. | |
| 2012/0244154 A1 | 9/2012 | Daugherty et al. | |
| 2015/0064169 A1 | 3/2015 | Wang et al. | |
| 2015/0297741 A1 | 10/2015 | Robillard | |
| 2016/0144042 A1 | 5/2016 | Williams et al. | |
| 2016/0194399 A1 | 7/2016 | Irving et al. | |
| 2016/0289324 A1 | 10/2016 | Moore et al. | |
| 2017/0152323 A1 | 6/2017 | Chang et al. | |
| 2018/0057593 A1 | 3/2018 | Dennis | |
| 2019/0359721 A1 | 11/2019 | Igawa et al. | |
| 2019/0367576 A1 | 12/2019 | Winston et al. | |
| 2020/0207846 A1 | 7/2020 | Igawa et al. | |
| 2020/0369781 A1 | 11/2020 | Igawa et al. | |
| 2021/0155701 A1 | 5/2021 | Hoshino et al. | |
| 2021/0206845 A1 | 7/2021 | Igawa et al. | |
| 2021/0221875 A1 | 7/2021 | Kitamura et al. | |
| 2021/0253672 A1 | 8/2021 | Ishikawa et al. | |
| 2022/0073632 A1 | 3/2022 | Igawa et al. | |

(Continued)

FOREIGN PATENT DOCUMENTS

| AU | 2016213702 A1 | 8/2016 |
|---|---|---|
| CA | 2548338 A1 | 6/2005 |

(Continued)

OTHER PUBLICATIONS

U.S. Appl. No. 16/463,218, 371(c) date May 22, 2019, Igawa, T., et al.
U.S. Appl. No. 16/463,222, 371(c) date May 22, 2019, Igawa, T., et al.
U.S. Appl. No. 16/766,600, 371(c) date May 22, 2020, Igawa, T., et al.
Alley, S. C., et al., "Antibody-drug conjugates: targeted drug delivery for cancer," Curr Opin Chem Biol., 14:529-537 (2010).
Asano, R. and Kumagai, I., "Functionalization of Bispecific Therapeutic Antibodies Based on Protein Engineering," Yakugaku Zasshi, 135(7):851-856 (2015), with partial English translation.

(Continued)

*Primary Examiner* — Meera Natarajan
*Assistant Examiner* — Cheom-Gil Cheong
(74) *Attorney, Agent, or Firm* — Nixon & Vanderhye P.C.

(57) ABSTRACT

The present invention relates to polypeptides containing an antigen-binding domain and a carrying moiety having an inhibiting domain that inhibits the antigen-binding activity of the antigen-binding domain, and having a longer half-life than that of the antigen-binding domain exist

(56) References Cited

U.S. PATENT DOCUMENTS

| | | |
|---|---|---|
| 2022/0315909 A1 | 10/2022 | Sakurai et al. |
| 2023/0069996 A1 | 3/2023 | Igawa et al. |

FOREIGN PATENT DOCUMENTS

| | | | |
|---|---|---|---|
| CA | 2591813 A1 | 6/2006 | |
| CA | 2607147 A1 | 11/2006 | |
| CA | 2666599 A1 | 2/2008 | |
| CA | 2678626 A1 | 9/2008 | |
| CA | 3041279 A1 | 5/2018 | |
| CA | 3083346 A1 | 6/2019 | |
| CN | 1665932 A | 9/2005 | |
| CN | 101821288 A | 9/2010 | |
| CN | 103068847 A | 4/2013 | |
| CN | 103842383 A | 6/2014 | |
| CN | 103958547 A | 7/2014 | |
| CN | 104661676 A | 5/2015 | |
| CN | 106459153 A | 2/2017 | |
| CN | 107207564 A | 9/2017 | |
| CN | 107602706 A | 1/2018 | |
| CN | 111836828 A | 10/2020 | |
| CN | 107602706 B | 12/2020 | |
| CN | 114127277 A | 3/2022 | |
| EP | 1505154 A1 | 2/2005 | |
| EP | 2957633 A1 | 12/2015 | |
| EP | 3546480 A1 | 10/2019 | |
| EP | 3546480 A1 | 10/2019 | |
| EP | 3546574 A1 | 10/2019 | |
| EP | 3556773 A1 | 10/2019 | |
| EP | 3719036 A1 | 10/2020 | |
| EP | 3981428 A1 | 4/2022 | |
| JP | 2005168328 A | 6/2005 | |
| JP | 2009512844 A | 3/2009 | |
| JP | 2010536370 A | 12/2010 | |
| JP | 2011026298 A | 2/2011 | |
| JP | 2012504035 A | 2/2012 | |
| JP | 2012514982 A | 7/2012 | |
| JP | 2013538204 A | 10/2013 | |
| JP | 2014509605 A | 4/2014 | |
| JP | 2015509952 A | 4/2015 | |
| JP | 2015517320 A | 6/2015 | |
| JP | 5753903 B2 | 7/2015 | |
| JP | 5765894 B2 | 8/2015 | |
| JP | 5851842 B2 | 2/2016 | |
| JP | 6035009 B2 | 11/2016 | |
| JP | 6130307 B2 | 5/2017 | |
| JP | 6178846 B2 | 8/2017 | |
| JP | 2017529853 A | 10/2017 | |
| JP | 2017530092 A | 10/2017 | |
| JP | 6273215 B2 | 1/2018 | |
| JP | 6577016 B | 9/2019 | |
| RU | 2012110127 A | 9/2013 | |
| RU | 2583876 C2 | 5/2016 | |
| RU | 2015101803 A | 8/2016 | |
| RU | 2636046 C2 | 11/2017 | |
| WO | WO 2004021861 A2 | 3/2004 | |
| WO | WO2005110453 A2 | 11/2005 | |
| WO | WO-2007027935 A2 | 3/2007 | |
| WO | WO2007045661 A1 | 4/2007 | |
| WO | WO-2007063308 A2 | 6/2007 | |
| WO | WO-2007063311 A2 | 6/2007 | |
| WO | WO2008045148 A2 | 4/2008 | |
| WO | WO-2008149149 A2 | 12/2008 | |
| WO | WO-2008157379 A2 | 12/2008 | |
| WO | WO-2009021754 A2 | 2/2009 | |
| WO | WO 2009025846 A2 | 2/2009 | |
| WO | WO2010039206 A1 | 4/2010 | |
| WO | WO 2010081173 A2 | 7/2010 | |
| WO | WO-2010081173 A2 * | 7/2010 | ........... A61K 39/395 |
| WO | WO 2010115998 A2 | 10/2010 | |
| WO | WO-2011020783 A3 | 4/2011 | |
| WO | WO-2011123683 A2 | 10/2011 | |
| WO | WO 2012025525 A1 | 3/2012 | |
| WO | WO2012028697 A1 | 3/2012 | |
| WO | WO-2012123755 A1 | 9/2012 | |
| WO | WO-2012158818 A2 | 11/2012 | |
| WO | WO2013046704 A2 | 4/2013 | |
| WO | WO 2013128194 A1 | 9/2013 | |
| WO | WO-2013148248 A1 | 10/2013 | |
| WO | WO-2013176730 A1 | 11/2013 | |
| WO | WO-2013180834 A2 | 12/2013 | |
| WO | WO-2013192550 A2 | 12/2013 | |
| WO | WO 2014052462 A2 | 4/2014 | |
| WO | WO-2014125955 A1 | 8/2014 | |
| WO | WO-2015066279 A2 | 5/2015 | |
| WO | WO-2015108998 A2 | 7/2015 | |
| WO | WO 2015116933 A2 | 8/2015 | |
| WO | WO-2015117930 A1 | 8/2015 | |
| WO | WO-2016014974 A2 | 1/2016 | |
| WO | WO2016016265 A1 | 2/2016 | |
| WO | WO-2016016269 A1 | 2/2016 | |
| WO | WO-2016046778 A2 | 3/2016 | |
| WO | WO2016077505 A2 | 5/2016 | |
| WO | WO 2016118629 A1 | 7/2016 | |
| WO | WO-2016179003 A1 | 11/2016 | |
| WO | WO-2016182064 A1 | 11/2016 | |
| WO | WO-2017025698 A1 | 2/2017 | |
| WO | WO-2017162587 A1 | 9/2017 | |
| WO | WO-2017220990 A1 | 12/2017 | |
| WO | WO-2018085555 A1 * | 5/2018 | ........... A61K 39/395 |
| WO | WO 2018097307 A1 | 5/2018 | |
| WO | WO 2018097308 A1 | 5/2018 | |
| WO | WO-2018220225 A1 | 12/2018 | |
| WO | WO-2018220236 A1 | 12/2018 | |
| WO | WO-2019010219 A1 | 1/2019 | |
| WO | WO-2019010224 A1 | 1/2019 | |
| WO | WO2019032471 A1 | 2/2019 | |
| WO | WO-2019107380 A1 | 6/2019 | |
| WO | WO 2019107384 A1 | 6/2019 | |
| WO | WO2019132472 A1 | 7/2019 | |
| WO | WO-2019173832 A2 | 9/2019 | |
| WO | WO-2019222294 A1 | 11/2019 | |
| WO | WO-2019222295 A1 | 11/2019 | |
| WO | WO-2019222296 A1 | 11/2019 | |
| WO | WO-2019230866 A1 | 12/2019 | |
| WO | WO-2019230867 A1 | 12/2019 | |
| WO | WO-2019230868 A1 | 12/2019 | |
| WO | WO-2020069398 A1 | 4/2020 | |
| WO | WO-2020072821 A2 | 4/2020 | |
| WO | WO-2020246567 A1 | 12/2020 | |
| WO | WO-2021149697 A1 | 7/2021 | |
| WO | WO2023002952 A1 | 1/2023 | |

OTHER PUBLICATIONS

Baeuerle, P. A., et al., "BITE: Teaching antibodies to engage T-cells for cancer therapy," Curr Opin Mol Ther., 11(1):22-30 (2009).

De Bono, J., et al., "ING-1, a monoclonal antibody targeting Ep-CAM in patients with advanced adenocarcinomas," Clin Cancer Res., 10(22):7555-7565 (2004).

Desjarlais, J. R., et al., "Optimizing engagement of the immune system by anti-tumor antibodies: an engineer's perspective," Drug Discov Today, 12(21/22):898-910 (2007).

Desnoyers, L. R., et al., "Tumor-Specific Activation of an EGFR-Targeting Probody Enhances Therapeutic Index," Sci Trans Med., 5(207):207ra144 (2013), 10 pages.

Erster, O., et al., "Site-specific targeting of antibody activity in vivo mediated by disease-associated proteases," J Control Release, 161:804-812 (2012).

Gerspach, J., et al., "Target-selective activation of a TNF prodrug by urokinase-type plasminogen activator (uPA) mediated proteolytic processing at the cell surface," Cancer Immunol Immunother., 55:1590-1600 (2006).

Gladkov, O., et al., "Cyclophosphamide and tucotuzumab (huKS-IL2) following first-line chemotherapy in responding patients with extensive-disease small-cell lung cancer," Anti-Cancer Drugs, 26(10):1061-1068 (2015).

International Search Report dated Feb. 26, 2019 in International Patent Application No. PCT/JP2018/043664.

International Search Report dated Feb. 26, 2019 in International Patent Application No. PCT/JP2018/043692.

(56) References Cited

OTHER PUBLICATIONS

Juszczak, A., et al., "Ipilimumab: a novel immunomodulating therapy causing autoimmune hypophysitis: a case report and review," Eur J Endocrinol., 167:1-5 (2012).
Kim, S. J., et al., "Antibody Engineering for the Development of Therapeutic Antibodies," Mol Cells, 20(1):17-29 (2005).
Lewis, G. D., et al., "Differential responses of human tumor cell lines to anti-p185HER2 monoclonal antibodies," Cancer Immunol Immunother., 37:255-263 (1993).
Lutterbuese, R., et al., "T cell-engaging BiTE antibodies specific for EGFR potently eliminate KRAS- and BRAF-mutated colorectal cancer cells," PNAS, 107(28):12605-12610 (2010).
Nam, J. L., et al., "Current evidence for the management of rheumatoid arthritis with biological disease-modifying antirheumatic drugs: a systematic literature review informing the EULAR recommendations for the management of RA," Ann Rheum Dis., 69:976-986 (2010).
Neri, D. and Sondel, P. M., "Immunocytokines for cancer treatment: past, present and future," Curr Opin Immunol., 40:96-102 (2016).
Paoloni, M., et al., "Defining the Pharmacodynamic Profile and Therapeutic Index of NHS-IL 12 Immunocytokine in Dogs with Malignant Melanoma," PLoS One, 10(6): e0129954 (2015), 20 pages.
Papadia, F., et al., "Isolated Limb Perfusion With the Tumor-Targeting Human Monoclonal Antibody-Cytokine Fusion Protein L19-TNF Plus Melphalan and Mild Hyperthermia in Patients with Locally Advanced Extremity Melanoma," J Surg Oncol., 107:173-179 (2013).
Pavlou, A. K. and Belsey, M. J., "The therapeutic antibodies market to 2008," Eur J Pharm Biopharm., 59:389-396 (2005).
Polu, K. R. and Lowman, H. B., "Probody therapeutics for targeting antibodies to diseased tissue," Expert Opin Biol Ther., 14(8):1049-1053 (2014).
Puskas, J., et al., "Development of an attenuated interleukin-2 fusion protein that can be activated by tumour-expressed proteases," Immunology, 133:206-220 (2011).
Reichert, J. M., et al., "Monoclonal antibody successes in the clinic," Nat Biotechnol., 23(9):1073-1078 (2005).
Riechelmann, H., et al., "Phase I trial with the CD44v6-targeting immunoconjugate bivatuzumab mertansine in head and neck squamous cell carcinoma," Oral Oncol., 44:823-829 (2008).
Satoh, M., et al., "Non-fucosylated therapeutic antibodies as next-generation therapeutic antibodies," Expert Opin Biol Ther., 6(11):1161-1173 (2006).
Takeuchi, T. and Kameda, H., "The Japanese experience with biologic therapies for rheumatoid arthritis," Nat Rev Rheumatol., 6:644-652 (2010).
Trinh, V. A. and Hwu, W.- J., "Ipilimumab in the treatment of melanoma," Expert Opin Biol Ther., 12(6):773-782 (2012).
Turk, B. E., et al., "Determination of protease cleavage site motifs using mixture-based oriented peptide libraries," Nat Biotechnol., 19:661-667 (2001).
Tzeng, A., et al., "Antigen specificity can be irrelevant to immunocytokine efficacy and biodistribution," PNAS, 112(11):3320-3325 (2015).
Van Roy, M., et al., "The preclinical pharmacology of the high affinity anti-IL-6R Nanobody ALX-0061 supports its clinical development in rheumatoid arthritis," Arth Res Ther., 17:135 (2015), 16 pages.
Weiner, L. M., et al., "Monoclonal antibodies: versatile platforms for cancer immunotherapy," Nat Rev Immunol., 10:317-327 (2010).
Wüest, T., et al., "TNF-Selectokine: a novel prodrug generated for tumor targeting and site-specific activation of tumor necrosis factor," Oncogene, 21:4257-4265 (2002).
Yamane, B. H., et al., "The development of antibody-IL-2 based immunotherapy with hu14.18-IL2 (EMD-273063) in melanoma and neuroblastoma," Expert Opin Investig Drugs, 18(7):991-1000 (2009).
U.S. Appl. No. 16/463,218, 371(c) date May 22, 2019, Igawa, T., et al., related application.

U.S. Appl. No. 16/463,222, 371(c) date May 22, 2019, Igawa, T., et al., related application.
U.S. Appl. No. 16/766,600, 371(c) date May 22, 2020, Igawa, T., et al., related application.
Abstract of ACR/ARHP Annual Meeting, accessed at [https://plan.core-apps.com/tristar_acr17/abstract/7f9a3c05b0ca255af1fc655b034e5eaa], Accessed on Apr. 23, 2018.
Acchione, M., et al., "Impact of Linker and Conjugation Chemistry on Antigen Binding, Fc Receptor Binding and Thermal Stability of Model Antibody-drug Conjugates, " MAbs, 4(3):362-372 (2012).
Cohen, S.B., et al., "A Randomized, Double-blind Study of AMG 108 (a Fully Human Monoclonal Antibody to IL-1R1) in Patients With Osteoarthritis of the Knee," Arthritis Research & Therapy, 13(4):R125 (2011).
Didomenico, C., et al., "Mechanically Aided Transport of Antibodies Through Articular Cartilage," Osteoarthritis and Cartilage, 23(2):A287-A288 (2015).
Dinarello, C.A., et al., "Treating Inflammation by Blocking Interleukin-1 in a Broad Spectrum of Diseases," Nature Reviews Drug Discovery, 11(8):633-652 (2012).
Halin, C., et al., "Synergistic Therapeutic Effects of a Tumor Targeting Antibody Fragment, Fused to Interleukin 12 and to Tumor Necrosis Factor Alpha," Cancer Research, 63(12):3202-3210 (2003).
Harmsen, M., et al., "Selection and Optimization of Proteolytically Stable Llama Single- domain Antibody Fragments for Oral Immunotherapy," Applied Microbiology and Biotechnology, 72(3):544-551 (2006).
Hussack, G., et al., "Engineered Single-Domain Antibodies with High Protease Resistance and Thermal Stability," PLoS One, 6(11):e28218 (2011).
Hutt, M., et al., "Plasma Half-life Extension of Small Recombinant Antibodies by Fusion to Immunoglobulin-binding Domains," J Biol Chem., 287(7):4462-4469 (2012).
Ishii, A., et al., "A receptor involved in the regulation of the pharmacokinetics of antibody-based pharmaceuticals: FcRn," Nihon Yakurigaku Zasshi. Folia Pharmacologica Japonica, 136(5):280-284 (2010).
Jia, H., et al., "EGFR Signaling is Critical for Maintaining the Superficial Layer of Articular Cartilage and Preventing Osteoarthritis Initiation," PNAS, 113(50):14360-14365 (2016).
Kiani, C., et al., "Structure and Function of Aggrecan," Cell Research, 12(1):19-32 (2002).
Knauf, M. J., et al., "Relationship of Effective Molecular Size to Systemic Clearance in Rats of Recombinant Interleukin-2 Chemically Modified with Water-soluble Polymers," J Biol Chem., 263(29):15064-15070 (1988).
Kromann-Hansen, T., et al., "A Camelid-derived Antibody Fragment Targeting the Active Site of a Serine Protease Balances Between Inhibitor and Substrate Behavior," The Journal of Biology Chemistry, 291(29):15156-15168 (2016).
Martel-Pelletier, J., et al., "Osteoarthritis," Nature Reviews Disease Primers, 2:16072 (2016).
Muller, S., et al., "Spliceosomal Peptide P140 For Immunotherapy of Systemic Lupus Erythematosus: Results of an Early Phase II Clinical Trial," Arthritis and Rheumatism, 58(12):3873-3883 (2008).
Office Action dated Mar. 18, 2021 in U.S. Appl. No. 16/463,222, filed May 22, 2019, Igawa et al.
R&D Systems, "Human Aggrecan G1-IGD-G2 Domains Antibody," Monoclonal Mouse IgG2B Clone # 179509, Catalog No. MAB1220, 1 page (2018).
Restriction Requirement dated Oct. 2, 2020 in U.S. Appl. No. 16/463,222, filed May 22, 2019, Igawa et al.
Roitt, I., et al., Immunology, M., Mir, 109-111 (2000) (in Russian, with what is believed to be a published English equivalent of those pages taken from Roitt, et al., Immunology, Fifth Ed., 78-81 (1998).
Sandersjoo, L., et al., "A New Prodrug Form of Affibody Molecules (Pro-affibody) is Selectively Activated by Cancer-associated Proteases," Cellular and Molecular Life Sciences, 72(7):1405-1415 (2015).
Schlapschy, M., et al., "Fusion of a recombinant antibody fragment with a homo-amino-acid polymer: effects on biophysical properties and prolonged plasma half-life," Prot Eng Des Sel., 20(6):273-284 (2007).

(56) References Cited

OTHER PUBLICATIONS

Seliverstov, et al., "Spinal Muscular Atrophies: Conception," Differential Diagnostics and Prospects for Treatment, 3:9-17 (2015).
Severin, Y. S., editor, "Biochemistry, Textbook for Higher Education," Moscow, Geotar-Med, 39-45 (2004).
Skrombolas, D., et al., "Development of an Interleukin-12 Fusion Protein That is Activated by Cleavage with Matrix Metalloproteinase 9," Journal of Interferon & Cytokine Research, 39(4):233-245 (2019).
Swearingen, C.A., et al., "Development of a Novel Clinical Biomarker Assay to Detect and Quantify Aggrecanase-generated Aggrecan Fragments in Human Synovial Fluid, Serum and Urine," Osteoarthritis and Cartilage, 18(9):1150-1158 (2010).
Thomas, D.A., et al., "A Broad-spectrum Fluorescence-based Peptide Library for the Rapid Identification of Protease Substrates," Proteomics, 6(7):2112-2120 (2006).
Torres, M. and Casadevall, A., "The Immunoglobulin Constant Region Contributes to Affinity and Specificity," Trends in Immunology, 29(2):91-97 (2008).
Vignali, D.A.A. and Kuchroo, V.K., "IL-12 Family Cytokines: Immunological Playmakers, "Nat Immunol, 13(8):722-728 (2012).
Xia, B., et al., "Osteoarthritis Pathogenesis: a Review of Molecular Mechanisms," Calcified Tissue International, 95(6):495-505 (2014).
U.S. Appl. No. 17/793,587, filed Jul. 18, 2022, Igawa et al., related application.
U.S. Appl. No. 17/058,889, filed Nov. 25, 2020, Hoshino et al., related application.
U.S. Appl. No. 17/058,896, filed Nov. 25, 2020, Ishikawa et al., related application.
U.S. Appl. No. 17/058,961, filed Nov. 25, 2020, Kitamura, H. et al., related application.
U.S. Appl. No. 17/615,633, filed Dec. 1, 2021, Sakurai et al., related application.
U.S. Appl. No. 12/821,711, filed Jun. 23, 2010, Ogawa et al.
U.S. Appl. No. 17/477,983, filed Sep. 17, 2021, Igawa et al., related application.
Allegra, C. J., et al., "Phase III Trial Assessing Bevacizumab in Stages II and III Carcinoma of the Colon: Results of NSABP Protocol C-08," J Clin Oncol., 29(1):11-16 (2011).
Badri, H., et al., "Optimization of radiation dosing schedules for proneural glioblastoma," J Math Biol., 72:1301-1336 (2016).
Baylot, V., et al., "TCTP Has a Crucial Role in the Different Stages of Prostate Cancer Malignant 4 Progression 5," TCTP/tpt1—Remodeling Signaling from Stem Cell to Disease. Results and Problems in Cell Differentiation, 64:255-261 (2017).
Mariuzza, R. A., et al., "The Structural Basis of Antigen-Antibody Recognition," Ann Rev Biophys Biophys Chem., 16:139-159 (1987).
Penn Medicine, News Release, "New Treatment Target Discovered That Halts Osteoarthritis-Like Knee Cartilage Degeneration," accessed Jul. 24, 2023 (2021).
Pratta, M. A., et al., "Aggrecan Protects Cartilage Collagen from Proteolytic Cleavage," J Biol Chem., 278(46):45539-45545 (2003).
Qin, Z.-X. and Liu, Z.-M., "The Research Progress in Yapsin Protease Family," Letters in Biotechnology, 19(4):591-596 (2008), with English abstract.
Roitt, I., et al., "Immunology," Fifth Edition, Moscow, Mir, 97-113 (2000).
Singer, M. and Berg, P., "Genes and Genomes," Moscow, Mir, 63 (1998).
Yarilin, A. A., Immunology Basics: Manual, Fundamentals of Immunology, Moscow, Medicina, 172-174 (1999).
U.S. Appl. No. 18/393,918, filed Dec. 22, 2023, Igawa et al., related application.
U.S. Appl. No. 18/580,385, filed Jan. 18, 2024, Chichili et al., related application.
Abi-Habib, R. J., et al., "A urokinase-activated recombinant diphtheria toxin targeting the granulocyte-macrophage colony-stimulating factor receptor is selectively cytotoxic to human acute myeloid leukemia blasts," Blood, 104:2143-2148 (2004).
Adkisson, H. D., et al., "Immune evasion by neocartilage-derived chondrocytes: Implications for biologic repair of joint articular cartilage," Stem Cell Res., 4:57-68 (2010).
Alberts, B., et al., "Molecular Biology of The Cell," Fifth Edition, Chapter 3 "Proteins," 125, 136 (2008).
Colman, P. M., "Effects of amino acid sequence changes on antibody-antigen interactions," Res Immunol., 145:33-36 (1994).
Dashivets, T., et al., "Oxidation in the complementarity-determining regions differentially influences the properties of therapeutic antibodies," MAbs, 8(8):1525-1535 (2016).
Derksen, P. W. B., et al., "Illegitimate WNT signaling promotes proliferation of multiple myeloma cells," PNAS, 101(16):6122-6127 (2004).
Dirks, P. B., "Brain Tumor Stem Cells: Bringing Order to the Chaos of Brain Cancer," J Clin Oncol., 26(17):2916-2924 (2008).
Fan, Z., et al., "Activation of Interleukin-1 Signaling Cascades in Normal and Osteoarthritic Articular Cartilage," Am J Pathol., 171(3):938-946 (2007).
Grunke, M. and Schulze-Koops, H., "Successful treatment of inflammatory knee osteoarthritis with tumour necrosis factor blockade," Ann Rheum Dis., 65:555-556 (2006).
Hybribody "VHH Nanobody Properties" accessed from hybribody.com on Oct. 21, 2022 (2016).
Kussie, P. H., et al., "A Single Engineered Amino Acid Substitution Changes Antibody Fine Specificity," J Immunol., 152:146-152 (1994).
López-Lázaro, M., "The migration ability of stem cells can explain the existence of cancer of unknown primary site. Rethinking metastasis." Oncoscience, 2(5):467-475 (2015).
Morgan, K., "What do anti-collagen antibodies mean?" Ann Rheum Dis., 49:62-65 (1990).
Office Action dated Oct. 26, 2022 in U.S. Appl. No. 17/058,961, filed Nov. 25, 2020, Kitamura et al.
Restriction Requirement dated Apr. 20, 2022 in U.S. Appl. No. 17/058,961, filed Nov. 25, 2020, Kitamura et al.
Rudikoff, S., et al. "Single amino acid substitution altering antigen-binding specificity," Proc Natl Acad Sci., 79:1979-1983 (1982).
Safdari, Y., et al., "Antibody humanization methods—a review and update," Biotechnol Genet Eng Rev., 29(2):175-186 (2013).
Tran, B. and Rosenthal, M. A., "Survival comparison between glioblastoma multiforme and other incurable cancers," J Clin Neurosci., 17:417-421 (2010).
Wei, S., editor, "Chapter 10 Monoclonal Antibody-Based Targeted Therapy on Tumors, Section 1 Research on Engineered Antibody for Treating Tumors," Clinical Tumor Biological Immunotherapy, 186 (2006).
Yokota, T., et al., "Rapid Tumor Penetration of a Single-Chain Fv and Comparison with Other Immunoglobulin Forms," Cancer Res., 52:3402-3408 (1992).

* cited by examiner

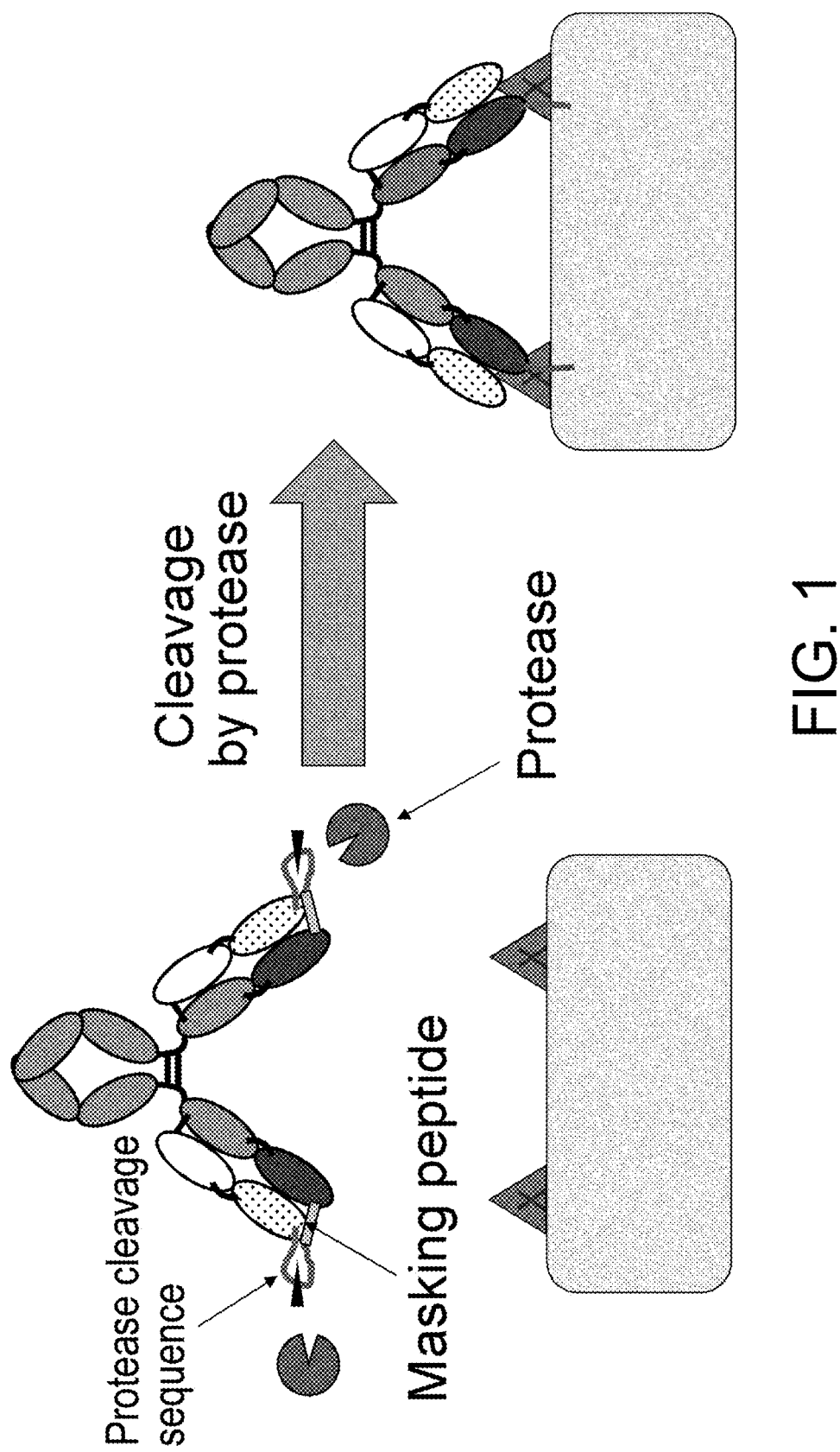

(A)

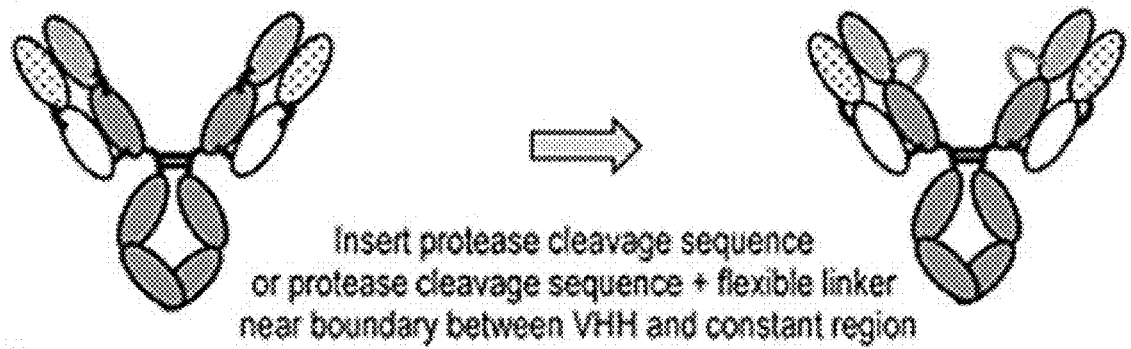

Insert protease cleavage sequence
or protease cleavage sequence + flexible linker
near boundary between VHH and constant region (B)

| Heavy chain name | Insertion site | Inserted amino acid sequence |
|---|---|---|
| 6R90H1001 | TVSSAS [insert] TKGP (SEQ ID NO:1088) | LSGRSDNH ( SEQ ID NO : 12 ) |
| 6R90H1002 | TVSSAS [insert] TKGP (SEQ ID NO:1082) | SGGSGLSGRSDNHGSSGG ( SEQ ID NO : 44 ) |
| 6R90H1003 | TV [insert] SSASTKGP (SEQ ID NO:1083) | LSGRSDNHG ( SEQ ID NO : 45) |
| 6R90H1004 | TV [insert] SSASTKGP (SEQ ID NO:1084) | SGGSGLSGRSDNHGSSGG ( SEQ ID NO : 44 ) |
| 6R90H1005 | TVSSASTK [insert] GP (SEQ ID NO:1085) | LSGRSDNHG ( SEQ ID NO :45 ) |
| 6R90H1006 | TVSSASTK [insert] GP (SEQ ID NO:1086) | SGGSGLSGRSDNHGSSGG ( SEQ ID NO : 44 ) |

FIG. 11

POLYPEPTIDE INCLUDING ANTIGEN-BINDING DOMAIN AND CARRYING SECTION

CROSS-REFERENCE TO RELATED APPLICATIONS

This application is a U.S. National Phase of PCT Application No. PCT/JP2018/043664, filed Nov. 28, 2018, which claims the benefit of Japanese Patent Application No. 2017-227650, filed Nov. 28, 2017, and Japanese Patent Application No. 2018-103682, filed May 30, 2018, each of which is incorporated herein by reference in its entirety.

REFERENCE TO SEQUENCE LISTING SUBMITTED ELECTRONICALLY

The content of the electronically submitted sequence listing (Name: 6663_0140_Substitute_Sequence_Listing.txt; Size: 761,556 bytes; and Date of Creation: Mar. 11, 2024) is incorporated herein by reference in its entirety.

TECHNICAL FIELD

The present invention relates to polypeptides comprising an antigen-binding domain and a carrying moiety having an inhibiting domain that inhibits the antigen-binding activity of the antigen-binding domain, and having a longer half-life than the half-life of the antigen-binding domain which exists alone, methods for producing and screening for the polypeptides, pharmaceutical compositions comprising the polypeptide, methods for producing and screening for a single-domain antibody whose antigen-binding activity can be inhibited by its association with particular VL, VH or VHH, and libraries of fusion polypeptides each comprising a single-domain antibody whose antigen-binding activity can be inhibited by its association with particular VL, VH or VHH.

BACKGROUND ART

Antibodies have received attention as drugs because of being highly stable in plasma and causing little side effects. Among them, many IgG-type antibody drugs have been launched, and a large number of antibody drugs are currently under development (NPLs 1 and 2).

Rituxan against CD20, cetuximab against EGFR, Herceptin against HER2, and the like have been approved so far as therapeutic drugs for cancer using antibody drugs (NPL 3). These antibody molecules bind to their antigens expressed on cancer cells and thereby exert cytotoxic activity against the cancer cells through ADCC activity, etc. Such cytotoxic activity based on ADCC activity, etc. is known to depend on the number of antigens expressed on target cells of therapeutic antibodies (NPL 4). Therefore, high expression levels of targeted antigens are preferred from the viewpoint of the effects of therapeutic antibodies. However, if an antigen, albeit having a high expression level, is expressed in normal tissues, the cytotoxic activity based on ADCC activity, etc. is exerted against the normal cells. Hence, side effects become a serious problem. Therefore, it is preferred that antigens targeted by therapeutic antibodies as therapeutic drugs for cancer should be expressed specifically on cancer cells. For example, an antibody molecule against EpCAM known as a cancer antigen had been considered promising as a therapeutic drug for cancer. However, the EpCAM is known to be also expressed in the pancreas. In actuality, it has been reported in clinical trials that the administration of an anti-EpCAM antibody causes pancreatitis as a side effect due to cytotoxic activity against the pancreas (NPL 5).

In the wake of the success of antibody drugs exerting cytotoxic activity based on ADCC activity, second-generation improved antibody molecules exerting strong cytotoxic activity have been reported as a result of, for example, enhancing ADCC activity by the removal of fucose from the N-linked oligosaccharide of a native human IgG1 Fc region (NPL 6) or enhancing ADCC activity by enhancing binding to FcγRIIIa through the amino acid substitution of a native human IgG1 Fc region (NPL 7). Improved antibody molecules exerting stronger cytotoxic activity, such as an antibody drug conjugate (ADC) containing an antibody conjugated with a drug having strong cytotoxic activity (NPL 8), and a low-molecular antibody exerting cytotoxic activity against cancer cells by recruiting T cells to the cancer cells (NPL 9) have also been reported as antibody drugs exerting cytotoxic activity against cancer cells under a mechanism other than NK cell-mediated ADCC activity as mentioned above.

Such antibody molecules exerting stronger cytotoxic activity can exert cytotoxic activity even against cancer cells expressing an antigen at a level that is not high, but also exert cytotoxic activity against normal tissues expressing the antigen at a low level, similarly to cancer cells. In actuality, EGFR-BiTE, a bispecific antibody against CD3 and EGFR, can exert strong cytotoxic activity against cancer cells and exert an antitumor effect, by recruiting T cells to the cancer cells, as compared with cetuximab, native human IgG1 against the EGFR. On the other hand, it has also been found that serious side effects appear by the administration of EGFR-BiTE to cynomolgus monkeys, because EGFR is also expressed in normal tissues (NPL 10). Also, ADC bivatuzumab mertansine containing mertansine conjugated with an antibody against CD44v6 highly expressed on cancer cells has been clinically found to cause severe dermal toxicity and hepatotoxicity, because CD44v6 is also expressed in normal tissues (NPL 11).

As mentioned above, use of an antibody that can exert strong cytotoxic activity even against cancer cells expressing an antigen at low levels requires the target antigen to be expressed in an exceedingly cancer-specific manner. However, considering that a target antigen HER2 of Herceptin or a target antigen EGFR of cetuximab is also expressed in normal tissues, only a limited number of cancer antigens may be expressed in an exceedingly cancer-specific manner. Therefore, side effects ascribable to a cytotoxic effect on normal tissues may become a problem, though cytotoxic activity against cancer can be enhanced.

Recently, ipilimumab, which enhances tumor immunity by inhibiting CTLA4 contributing to immunosuppression in cancer, has been shown to extend overall survival in metastatic melanoma (NPL 12). However, ipilimumab systemically inhibits CTLA4 and therefore causes autoimmune disease-like severe side effects due to the systemic activation of immunity, though enhancing the tumor immunity (NPL 13).

Meanwhile, antibody drugs exerting a therapeutic effect by inhibiting inflammatory cytokines in inflammatory or autoimmune diseases are known as antibody drugs against diseases other than cancer (NPL 14). It is known that, for example, Remicade or Humira targeting TNF, and Actemra targeting IL-6R exert a high therapeutic effect on rheumatoid arthritis, whereas infectious disease is seen as a side effect due to the systemic neutralization of these cytokines (NPL 15).

Various techniques have been developed as techniques applicable to second-generation antibody drugs. For example, techniques of improving effector functions, antigen-binding ability, pharmacokinetics, or stability or reducing a risk of immunogenicity have been reported (NPL 16). However, there are still a few reports on techniques that allow antibody drugs to act specifically on a target tissue in order to solve side effects as described above. The reported techniques include a method which involves connecting an antibody to a masking peptide via a linker that is cleaved by protease expressed at a lesion site such as a cancer tissue or an inflammatory tissue, thereby masking the antigen-binding site of the antibody with the masking peptide and inhibiting the antigen-binding activity of the antibody; and dissociating the masking peptide therefrom by the protease cleavage of this linker so that the antibody restores its antigen-binding activity and becomes capable of binding to the antigen in a target pathological tissue (NPLs 17 and 18 and PTL 1).

CITATION LIST

Patent Literature

[PTL 1] WO 2010/081173

Non Patent Literature

[NPL 1] Monoclonal antibody successes in the clinic. Janice M Reichert, Clark J Rosensweig, Laura B Faden & Matthew C Dewitz, Nat. Biotechnol. (2005) 23, 1073-1078
[NPL 2] The therapeutic antibodies market to 2008. Pavlou A K, Belsey M J., Eur. J. Pharm. Biopharm. (2005) 59 (3), 389-396
[NPL 3] Monoclonal antibodies: versatile platforms for cancer immunotherapy. Weiner L M, Surana R, Wang S., Nat. Rev. Immunol. (2010) 10 (5), 317-327
[NPL 4] Differential responses of human tumor cell lines to anti-p185HER2 monoclonal antibodies. Lewis G D, Figari I, Fendly B, Wong W L, Carter P, Gorman C, Shepard H M, Cancer Immunol. Immunotherapy (1993) 37, 255-263
[NPL 5] ING-1, a monoclonal antibody targeting Ep-CAM in patients with advanced adenocarcinomas. de Bono J S, Tolcher A W, Forero A, Vanhove G F, Takimoto C, Bauer R J, Hammond L A, Patnaik A, White M L, Shen S, Khazaeli M B, Rowinsky E K, LoBuglio A F, Clin. Cancer Res. (2004) 10 (22), 7555-7565
[NPL 6] Non-fucosylated therapeutic antibodies as next-generation therapeutic antibodies. Satoh M, Iida S, Shitara K., Expert Opin. Biol. Ther. (2006) 6 (11), 1161-1173
[NPL 7] Optimizing engagement of the immune system by anti-tumor antibodies: an engineer's perspective. Desjarlais J R, Lazar G A, Zhukovsky E A, Chu S Y., Drug Discov. Today (2007) 12 (21-22), 898-910
[NPL 8] Antibody-drug conjugates: targeted drug delivery for cancer. Alley S C, Okeley N M, Senter P D., Curr. Opin. Chem. Biol. (2010) 14 (4), 529-537
[NPL 9] BiTE: Teaching antibodies to engage T-cells for cancer therapy. Baeuerle P A, Kufer P, Bargou R., Curr. Opin. Mol. Ther. (2009) 11 (1), 22-30
[NPL 10] T cell-engaging BiTE antibodies specific for EGFR potently eliminate KRAS- and BRAF-mutated colorectal cancer cells. Lutterbuese R, Raum T, Kischel R, Hoffmann P, Mangold S, Rattel B, Friedrich M, Thomas O, Lorenczewski G, Rau D, Schaller E, Herrmann I, Wolf A, Urbig T, Baeuerle P A, Kufer P., Proc. Natl. Acad. Sci. U.S.A. (2010) 107 (28), 12605-12610
[NPL 11] Phase I trial with the CD44v6-targeting immunoconjugate bivatuzumab mertansine in head and neck squamous cell carcinoma. Riechelmann H, Sauter A, Golze W, Hanft G, Schroen C, Hoermann K, Erhardt T, Gronau S., Oral Oncol. (2008) 44 (9), 823-829
[NPL 12] Ipilimumab in the treatment of melanoma. Trinh V A, Hwu W J., Expert Opin. Biol. Ther., 2012 Apr. 14 (doi: 10.1517/14712598.2012.675325)
[NPL 13] IPILIMUMAB—A NOVEL IMMUNOMODULATING THERAPY CAUSING AUTOIMMUNE HYPOPHYSITIS: A CASE REPORT AND REVIEW. Juszczak A, Gupta A, Karavitaki N, Middleton M R, Grossman A., Eur. J. Endocrinol. 2012 Apr. 10 (doi: 10.1530/EJE-12-0167)
[NPL 14] The Japanese experience with biologic therapies for rheumatoid arthritis. Takeuchi T, Kameda H., Nat. Rev. Rheumatol. (2010) 6 (11), 644-652
[NPL 15] Current evidence for the management of rheumatoid arthritis with biological disease-modifying antirheumatic drugs: a systematic literature review informing the EULAR recommendations for the management of R A. Nam J L, Winthrop K L, van Vollenhoven R F, Pavelka K, Valesini G, Hensor E M, Worthy G, Landewe R, Smolen J S, Emery P, Buch M H., Ann. Rheum. Dis. (2010) 69 (6), 976-986
[NPL 16] Antibody engineering for the development of therapeutic antibodies. Kim S J, Park Y, Hong H J., Mol. Cells. (2005) 20 (1), 17-29
[NPL 17] Tumor-specific activation of an EGFR-targeting probody enhances therapeutic index. Desnoyers L R, Vasiljeva O, Richardson J H, Yang A, Menendez E E, Liang T W, Wong C, Bessette P H, Kamath K, Moore S J, Sagert J G, Hostetter D R, Han F, Gee J, Flandez J, Markham K, Nguyen M, Krimm M, Wong K R, Liu S, Daugherty P S, West J W, Lowman H B. Sci Transl Med. 2013 Oct. 16; 5(207): 207ra144.
[NPL 18] Probody therapeutics for targeting antibodies to diseased tissue. Polu K R, Lowman H B. Expert Opin Biol Ther. 2014 August; 14(8): 1049-53.

SUMMARY OF INVENTION

Technical Problem

The present inventors have thought that the techniques of dissociating, by protease cleavage, a masking peptide inhibiting the antigen-binding activity of an antibody so that the antibody restores its antigen-binding activity, as described above might cause side effects, because the antibody cleaved at a lesion site may distribute to normal tissues through blood flow, as the cleavage by protease is irreversible.

The present invention has been made on the basis of such an idea. An object of the present invention is to provide a pharmaceutical composition useful in disease treatment with less side effects, and an active ingredient thereof. Another object of the present invention is to provide methods for screening for and producing the pharmaceutical composition and the active ingredient.

Solution to Problem

The present inventors have conducted diligent studies and consequently developed polypeptides comprising an antigen-binding domain and a carrying moiety having an inhibiting domain that inhibits the binding activity of the antigen-binding domain, and having a longer half-life than the half-life of the antigen-binding domain which exists alone. It is considered that use of the polypeptide can allow the antigen-binding domain to restore its antigen-binding activity in a disease tissue(s) and exert the antigen-binding activity in the disease tissue(s). Furthermore, the systemic distribution of an activated form of the antigen-binding domain can be suppressed owing to the difference in half-lives between the polypeptide comprising the antigen-binding domain whose antigen-binding activity is inhibited and a polypeptide comprising the antigen-binding domain whose antigen-binding activity is restored. Moreover, the present inventors have found that the polypeptides or pharmaceutical compositions comprising the polypeptide are useful in disease treatment and also found that the polypeptides or the pharmaceutical compositions are useful in disease treatment which involves administering the polypeptide; and that the polypeptides are useful in the production of a drug for disease treatment. The present inventors have further developed methods for screening for and producing the polypeptide, methods for producing and screening for a single-domain antibody whose antigen-binding activity can be inhibited by its association with particular VL, VH or VHH, and libraries including a single-domain antibody whose antigen-binding activity can be inhibited by its association with particular VL, VH or VHH, and completed the present invention.

The present invention is based on these findings and specifically encompasses exemplary embodiments described below.

(1) A polypeptide comprising an antigen-binding domain and a carrying moiety, the carrying moiety having an inhibiting domain that inhibits the antigen-binding activity of the antigen-binding domain, and the antigen-binding domain having a shorter half-life in blood than that of the carrying moiety.

(2) The polypeptide according to (1), wherein the molecular weight of the antigen-binding domain is smaller than that of the carrying moiety.

(3) The polypeptide according to (1) or (2), wherein the molecular weight of the antigen-binding domain is 60 kDa or smaller.

(4) The polypeptide according to any of (1) to (3), wherein the carrying moiety has FcRn-binding activity, and the antigen-binding domain has no FcRn-binding activity or has weaker FcRn-binding activity than that of the carrying moiety.

(5) The polypeptide according to any of (1) to (4), wherein the antigen-binding domain is capable of being released from the polypeptide, and the antigen-binding domain released from the polypeptide has higher antigen-binding activity than that before the release.

(6) The polypeptide according to any of (1) to (5), wherein the inhibiting domain of the carrying moiety is associated with the antigen-binding domain and thereby inhibits the antigen-binding activity of the antigen-binding domain.

(7) The polypeptide according to (5), wherein the polypeptide comprises a cleavage site, wherein the cleavage site is cleaved so that the antigen-binding domain becomes capable of being released from the polypeptide.

(8) The polypeptide according to (6), wherein the polypeptide comprises a cleavage site, wherein the cleavage site is cleaved so that the association of the inhibiting domain of the carrying moiety with the antigen-binding domain is canceled.

(9) The polypeptide according to (7) or (8), wherein the cleavage site comprises a protease cleavage sequence.

(10) The polypeptide according to (9), wherein the protease is a target tissue specific protease.

(11) The polypeptide according to (10), wherein the target tissue is a cancer tissue or an inflammatory tissue.

(12) The polypeptide according to (9), wherein the protease is at least one protease selected from matriptase, urokinase (uPA), and metalloproteinase.

(13) The polypeptide according to (12), wherein the protease is at least one protease selected from MT-SP1, uPA, MMP-2, MMP-9, ADAMTS5, MMP-7, and MMP-13.

(14) The polypeptide according to (9), wherein the protease cleavage sequence comprises one or a plurality of sequence sequences selected from the sequences of SEQ ID NOs: 12, 25, 26, 78 to 81, 83, 84, 91, 168 to 178, 193 to 195, 833 to 852, and 1062 to 1081, and the sequences shown in Table 1.

(15) The polypeptide according to any of (9) to (14), wherein a first flexible linker is further attached to one end of the protease cleavage sequence.

(16) The polypeptide according to (15), wherein a second flexible linker is further attached to the other end of the protease cleavage sequence.

(17) The polypeptide according to (15), wherein the first flexible linker is a flexible linker consisting of a glycine-serine polymer.

(18) The polypeptide according to (16), wherein the second flexible linker is a flexible linker consisting of a glycine-serine polymer.

(19) The polypeptide according to any of (1) to (18), wherein the antigen-binding domain comprises a single-domain antibody or is a single-domain antibody, wherein the inhibiting domain of the carrying moiety inhibits the antigen-binding activity of the single-domain antibody.

(20) The polypeptide according to (19), wherein the single-domain antibody is VHH, VH having antigen-binding activity by itself, or VL having antigen-binding activity by itself.

(21) The polypeptide according to any of (1) to (20), wherein the antigen-binding domain comprises a single-domain antibody, and the inhibiting domain of the carrying moiety is VHH, antibody VH, or antibody VL, wherein the antigen-binding activity of the single-domain antibody is inhibited by the VHH, the antibody VH, or the antibody VL.

(22) The polypeptide according to any of (1) to (21), wherein the antigen-binding domain comprises a single-domain antibody, and the inhibiting domain of the carrying moiety is VHH, antibody VH, or antibody VL, wherein the antigen-binding activity of the single-domain antibody is inhibited by its association with the VHH, the antibody VH, or the antibody VL.

(23) The polypeptide according to any of (19) to (22), wherein the single-domain antibody is VHH or VH having antigen-binding activity by itself, and the inhibiting domain of the carrying moiety is antibody VL, wherein the antigen-binding activity of the VHH or the VH having antigen-binding activity by itself is inhibited by its association with the antibody VL.

(24) The polypeptide according to any of (19) to (23), wherein the single-domain antibody is VHH, wherein the VHH has an amino acid substitution at at least one position selected from amino acid positions 37, 44, 45, and 47 (all according to the Kabat numbering).

(25) The polypeptide according to any of (19) to (23), wherein the single-domain antibody is VHH, wherein the VHH contains at least one amino acid selected from amino acids 37V, 44G, 45L, and 47W (all according to the Kabat numbering).
(26) The polypeptide according to any of (19) to (23), wherein the single-domain antibody is VHH, wherein the VHH contains at least one amino acid substitution selected from amino acid substitutions F37V, Y37V, E44G, Q44G, R45L, H45L, G47W, F47W, L47W, T47W, and S47W (all according to the Kabat numbering).
(27) The polypeptide according to any of (19) to (23), wherein the single-domain antibody is VHH, wherein the VHH has amino acid substitutions at at least one set of positions selected from positions 37/44, positions 37/45, positions 37/47, positions 44/45, positions 44/47, positions 45/47, positions 37/44/45, positions 37/44/47, positions 37/45/47, positions 44/45/47, and positions 37/44/45/47 (all according to the Kabat numbering).
(28) The polypeptide according to any of (19) to (23), wherein the single-domain antibody is VHH, wherein the VHH contains at least one set of amino acids selected from 37V/44G, 37V/45L, 37V/47W, 44G/45L, 44G/47W, 45L/47W, 37V/44G/45L, 37V/44G/47W, 37V/45L/47W, 44G/45L/47W, and 37V/44G/45L/47W (all according to the Kabat numbering).
(29) The polypeptide according to any of (19) to (23), wherein the single-domain antibody is VHH, wherein the VHH contains at least one set of amino acid substitutions selected from F37V/R45L, F37V/G47W, R45L/G47W, and F37V/R45L/G47W (all according to the Kabat numbering).
(30) The polypeptide according to any of (19) to (22), wherein the single-domain antibody is VL having antigen-binding activity by itself, and the inhibiting domain of the carrying moiety is antibody VH, wherein the antigen-binding activity of the VL having antigen-binding activity by itself is inhibited by its association with the antibody VH.
(31) The polypeptide according to any of (1) to (30), wherein the carrying moiety has an FcRn binding region.
(32) The polypeptide according to any of (1) to (31), wherein the carrying moiety comprises an antibody constant region.
(33) The polypeptide according to (32), wherein the antibody constant region of the carrying moiety and the antigen-binding domain are fused via a linker or without a linker.
(34) The polypeptide according to (32), wherein the carrying moiety comprises an antibody heavy chain constant region, wherein the antibody heavy chain constant region and the antigen-binding domain are fused via a linker or without a linker.
(35) The polypeptide according to (32), wherein the carrying moiety comprises an antibody light chain constant region, wherein the antibody light chain constant region and the antigen-binding domain are fused via a linker or without a linker.
(36) The polypeptide according to (34), wherein in the polypeptide, the N terminus of the antibody heavy chain constant region of the carrying moiety and the C terminus of the antigen-binding domain are fused via a linker or without a linker, and the polypeptide further has a protease cleavage sequence, wherein the protease cleavage sequence is located within the sequence of the antigen-binding domain, or in the antibody heavy chain constant region on the side closer to the antigen-binding domain beyond the amino acid of position 122 (EU numbering).
(37) The polypeptide according to (35), wherein in the polypeptide, the N terminus of the antibody light chain constant region of the carrying moiety and the C terminus of the antigen-binding domain are fused via a linker or without a linker, and the polypeptide further has a protease cleavage sequence, wherein the protease cleavage sequence is located within the sequence of the antigen-binding domain, or in the antibody light chain constant region on the side closer to the antigen-binding domain beyond the amino acid of position 113 (EU numbering) (Kabat numbering position 113).
(38) The polypeptide according to any of (33) to (35), wherein in the polypeptide, the N terminus of the antibody constant region of the carrying moiety and the C terminus of the antigen-binding domain are fused via a linker or without a linker, the antigen-binding domain is a single-domain antibody prepared from VH, or VHH, and the polypeptide further has a protease cleavage sequence, wherein the protease cleavage sequence is located within the sequence of the antibody constant region, or in the single-domain antibody of the antigen-binding domain on the side closer to antibody constant region beyond the amino acid position of 109 (Kabat numbering).
(39) The polypeptide according to (33), wherein in the polypeptide, the N terminus of the antibody constant region of the carrying moiety and the C terminus of the antigen-binding domain are fused via a linker or without a linker, and the polypeptide further has a protease cleavage sequence, wherein the protease cleavage sequence is located near the boundary between the antigen-binding domain and the antibody constant region.
(40) The polypeptide according to (34), wherein in the polypeptide, the N terminus of the antibody heavy chain constant region of the carrying moiety and the C terminus of the antigen-binding domain are fused via a linker or without a linker, and the polypeptide further has a protease cleavage sequence, wherein the protease cleavage sequence is located near the boundary between the antigen-binding domain and the antibody heavy chain constant region.
(41) The polypeptide according to (35), wherein in the polypeptide, the N terminus of the antibody light chain constant region of the carrying moiety and the C terminus of the antigen-binding domain are fused via a linker or without a linker, and the polypeptide further has a protease cleavage sequence, wherein the protease cleavage sequence is located near the boundary between the antigen-binding domain and the antibody light chain constant region.
(42) The polypeptide according to (40), wherein the antigen-binding domain is a single-domain antibody prepared from VH, or VHH, and the protease cleavage sequence is located at any position between the amino acid position of 109 (Kabat numbering) of the single-domain antibody of the antigen-binding domain and the amino acid of position 122 (EU numbering) of the antibody heavy chain constant region.
(43) The polypeptide according to (41), wherein the antigen-binding domain is a single-domain antibody prepared from VH, or VHH, and the protease cleavage sequence is located at any position between the amino acid of position 109 (Kabat numbering) of the single-domain antibody of the antigen-binding domain and the amino acid of position 113 (EU numbering) (Kabat numbering position 113) of the antibody light chain constant region.

(44) The polypeptide according to (40), wherein the antigen-binding domain is a single-domain antibody prepared from VL, and the protease cleavage sequence is located at any position between the amino acid of position 104 (Kabat numbering) of the single-domain antibody of the antigen-binding domain and the amino acid of position 122 (EU numbering) of the antibody heavy chain constant region.

(45) The polypeptide according to (41), wherein the antigen-binding domain is a single-domain antibody prepared from VL, and the protease cleavage sequence is located at any position between the amino acid of position 109 (Kabat numbering) of the single-domain antibody of the antigen-binding domain and the amino acid of position 113 (EU numbering) (Kabat numbering position 113) of the antibody light chain constant region.

(46) The polypeptide according to any of (32) to (45), wherein the antibody constant region of the polypeptide is an IgG antibody constant region.

(47) The polypeptide according to any of (1) to (46), wherein the polypeptide is an IgG antibody-like molecule.

(48) The polypeptide according to any of (1) to (47), wherein when the antigen-binding domain is assayed in an unreleased state by use of BLI (bio-layer interferometry) (Octet), the binding of the antigen-binding domain to the antigen is not seen.

(49) The polypeptide according to any of (1) to (48), wherein a second antigen-binding domain is further linked to the antigen-binding domain.

(50) The polypeptide according to (49), wherein the second antigen-binding domain has antigen-binding specificity different from that of the antigen-binding domain.

(51) The polypeptide according to (49) or (50), wherein the second antigen-binding domain comprises a second single-domain antibody.

(52) The polypeptide according to (51), wherein the antigen-binding domain is a single-domain antibody, the second antigen-binding domain is a second single-domain antibody, and the antigen-binding domain and the second antigen-binding domain are capable of being released from the polypeptide, wherein the single-domain antibody and the second single-domain antibody form a bispecific antigen-binding molecule in released states of the antigen-binding domain and the second antigen-binding domain.

(53) The polypeptide according to any of (49) to (52), wherein the second antigen-binding domain is directed to HER2 or GPC3 as a target antigen.

(54) The polypeptide according to any of (1) to (53), wherein the polypeptide further has an additional antigen-binding domain different from the antigen-binding domain, wherein the antigen-binding activity of the additional antigen-binding domain is also inhibited by its linkage to the carrying moiety of the polypeptide.

(55) The polypeptide according to (54), wherein the additional antigen-binding domain and the antigen-binding domain differ in antigen-binding specificity.

(56) The polypeptide according to any of (1) to (55), wherein the antigen-binding domain is an antigen-binding domain directed to Plexin A1, IL-6R or CD3 as a target antigen.

(57) A pharmaceutical composition comprising the polypeptide of any of (1) to (56).

(58) A method for producing the polypeptide of any of (1) to (56).

(59) The production method according to (58), comprising the following steps:
  (a) obtaining a single-domain antibody binding to a target antigen;
  (b) linking the single-domain antibody obtained in the step (a) to a carrying moiety such that the antigen-binding activity of the single-domain antibody is inhibited by an inhibiting domain of the carrying moiety, to form a polypeptide precursor; and
  (c) introducing a protease cleavage sequence into the polypeptide precursor.

(60) The production method according to (58), comprising the following steps:
  (a) obtaining a single-domain antibody binding to a target antigen;
  (b) linking the single-domain antibody obtained in the step (a) to a carrying moiety such that the antigen-binding activity of the single-domain antibody is inhibited by an inhibiting domain of the carrying moiety, to form a polypeptide precursor; and
  (c) introducing a protease cleavage sequence to near the boundary between the single-domain antibody and the carrying moiety.

(61) The production method according to (58), comprising the following steps:
  (a) obtaining a single-domain antibody binding to a target antigen; and
  (b) linking the single-domain antibody obtained in the step (a) to a carrying moiety via a protease cleavage sequence such that the antigen-binding activity of the single-domain antibody is inhibited by an inhibiting domain of the carrying moiety, to form a polypeptide.

(62) The production method according to any of (59) to (61), further comprising the following step:
  (d) confirming that the binding activity of the single-domain antibody incorporated in the polypeptide or the polypeptide precursor against the target antigen is weakened or lost.

(63) The production method according to any of (59) to (62), further comprising the following step:
  (e) releasing the single-domain antibody by the protease cleavage of the protease cleavage sequence and confirming that the released single-domain antibody binds to the antigen.

(64) The production method according to (58), wherein the polypeptide is an IgG antibody-like molecule.

(65) The production method according to (64), comprising the following steps:
  (a) obtaining a single-domain antibody binding to a target antigen;
  (b) allowing the single-domain antibody obtained in the step (a) to be associated with a VL as a substitute for VH of an IgG antibody, or allowing the single-domain antibody to be associated with a VH as a substitute for VL of an IgG antibody such that the antigen-binding activity of the single-domain antibody is inhibited, to form an IgG antibody-like molecule precursor harboring the single-domain antibody; and
(c) introducing a protease cleavage sequence into the IgG antibody-like molecule precursor harboring the single-domain antibody.
(66) The production method according to (64), comprising the following steps:
(a) obtaining a single-domain antibody binding to a target antigen;
(b) allowing the single-domain antibody obtained in the step (a) to be associated with a VL as a substitute for VH of an IgG antibody, or allowing the single-domain antibody to be associated with a VH as a substitute for VL of an IgG antibody such that the antigen-binding activity of the single-domain antibody is inhibited, to form an IgG antibody-like molecule precursor harboring the single-domain antibody; and
(c) introducing a protease cleavage sequence to near the boundary between the single-domain antibody and an antibody constant region in the IgG antibody-like molecule precursor.
(67) The production method according to (64), comprising the following steps:
(a) obtaining a single-domain antibody binding to a target antigen; and
(b) linking the single-domain antibody obtained in the step (a) as a substitute for IgG antibody VH or VL to an IgG antibody heavy chain constant region or light chain constant region via a protease cleavage sequence such that the antigen-binding activity of the single-domain antibody is inhibited, to form an IgG antibody-like molecule harboring the single-domain antibody.
(68) The production method according to any of (65) to (67), further comprising the following step:
(d) confirming that the binding activity of the single-domain antibody harbored in the IgG antibody-like molecule or the IgG antibody-like molecule precursor against the target antigen is weakened or lost.
(69) The production method according to any of (65) to (68), further comprising the following step:
(e) releasing the single-domain antibody by the protease cleavage of the protease cleavage sequence and confirming that the released single-domain antibody binds to the target antigen.
(70) The production method according to (64), comprising the following steps:
(a) substituting an amino acid residue in a single-domain antibody that is involved in association of the single-domain antibody with antibody VH, or substituting an amino acid residue in a single-domain antibody that is involved in association of the single-domain antibody with antibody VL, to prepare a variant single-domain antibody retaining the binding activity of the single-domain antibody against the target antigen;
(b) allowing the variant single-domain antibody prepared in the step (a) to be associated with antibody VH, or allowing the variant single-domain antibody to be associated with antibody VL such that the antigen-binding activity of the variant single-domain antibody is inhibited, to form an IgG antibody-like molecule precursor harboring the variant single-domain antibody; and
(c) introducing a protease cleavage sequence into the IgG antibody-like molecule precursor harboring the variant single-domain antibody.
(71) The production method according to (64), comprising the following steps:
(a) substituting an amino acid residue in a single-domain antibody that is involved in association with antibody VH, or substituting an amino acid residue in a single-domain antibody that is involved in association with antibody VL, to prepare a variant single-domain antibody retaining the binding activity of the single-domain antibody against the target antigen;
(b) allowing the variant single-domain antibody prepared in the step (a) to be associated with antibody VH, or allowing the variant single-domain antibody to be associated with antibody VL such that the antigen-binding activity of the variant single-domain antibody is inhibited, to form an IgG antibody-like molecule precursor harboring the variant single-domain antibody; and
(c) introducing a protease cleavage sequence to near the boundary between the variant single-domain antibody and a constant region in the IgG antibody-like molecule precursor.
(72) The production method according to (64), comprising the following steps:
(a) substituting an amino acid residue in a single-domain antibody that is involved in association with antibody VH, or substituting an amino acid residue in a single-domain antibody that is involved in association with antibody VL, to prepare a variant single-domain antibody retaining the binding activity of the single-domain antibody against the target antigen; and
(b) linking the variant single-domain antibody prepared in the step (a) to an IgG antibody heavy chain constant region via a protease cleavage sequence, or linking the variant single-domain antibody to an IgG antibody light chain constant region via a protease cleavage sequence such that the antigen-binding activity of the variant single-domain antibody is inhibited, to form an IgG antibody-like molecule harboring the variant single-domain antibody.
(73) The production method according to any of (70) to (72), further comprising the following step:
(d) confirming that the binding activity of the variant single-domain antibody harbored in the IgG antibody-like molecule or the binding activity of the variant single-domain antibody harbored in the IgG antibody-like molecule precursor against the target antigen is weakened or lost.
(74) The production method according to any of (70) to (73), further comprising the following step:
(e) releasing the variant single-domain antibody by cleaving the protease cleavage sequence with a protease and confirming that the released variant single-domain antibody binds to the target antigen.
(75) A polynucleotide encoding the polypeptide according to any of (1) to (56).
(76) A vector comprising the polynucleotide according to (75).
(77) A host cell comprising the polynucleotide according to (75) or the vector according to (76).
(78) A method for producing the polypeptide according to any of (1) to (56), comprising the step of culturing the host cell according to (77).

(79) A method for screening for a single-domain antibody whose antigen-binding activity can be inhibited by its association with particular VL, by its association with particular VH, or by its association with particular VHH.
(80) The screening method according to (79), wherein the method is a method for screening for a single-domain antibody whose antigen-binding activity can be inhibited by its association with particular VL.
(81) The screening method according to (80), comprising the following steps:
   (a) obtaining a single-domain antibody having target antigen-binding activity;
   (b) allowing the single-domain antibody obtained in the step (a) to be associated with a particular VL; and
   (c) confirming that the binding activity of the single-domain antibody associated with the particular VL in the step (b) against the antigen is weakened as compared with that before the association or lost.
(82) The screening method according to (80), comprising the following steps:
   (a) allowing a single-domain antibody to be associated with a particular VL;
   (b) selecting an association product(s) formed of the VL and the single-domain antibody on the basis that the single-domain antibody associated with the particular VL in the step (a) has no binding activity or binding activity of a predetermined value or lower against the antigen; and
   (c) confirming that the single-domain antibody in the association product(s) selected in the step (b) has stronger binding activity against the antigen in a state unassociated with the particular VL than that in a state associated therewith.
(83) The screening method according to (79), wherein the method is a method for screening for a single-domain antibody whose antigen-binding activity can be inhibited by its association with particular VH.
(84) The screening method according to (83), comprising the following steps:
   (a) obtaining a single-domain antibody having target antigen-binding activity;
   (b) allowing the single-domain antibody obtained in the step (a) to be associated with a particular VH; and
   (c) confirming that the binding activity of the single-domain antibody associated with the particular VH in the step (b) against the antigen is weakened as compared with that before the association or lost.
(85) The screening method according to (83), comprising the following steps:
   (a) allowing a single-domain antibody to be associated with a particular VH;
   (b) selecting an association product(s) formed of the VH and the single-domain antibody on the basis that the single-domain antibody associated with the particular VH in the step (a) has no binding activity or binding activity of a predetermined value or lower against the antigen; and
   (c) confirming that the single-domain antibody in the association product(s) selected in the step (b) has stronger binding activity against the antigen in a state unassociated with the particular VH than that in a state associated therewith.
(86) The screening method according to (79), wherein the method is a method for screening for a single-domain antibody whose antigen-binding activity can be inhibited by its association with particular VHH.
(87) The screening method according to (86), comprising the following steps:
   (a) obtaining a single-domain antibody having target antigen-binding activity;
   (b) allowing the single-domain antibody obtained in the step (a) to be associated with a particular VHH; and
   (c) confirming that the binding activity of the single-domain antibody associated with the particular VHH in the step (b) against the antigen is weakened as compared with that before the association or lost.
(88) The screening method according to (86), comprising the following steps:
   (a) allowing a single-domain antibody to be associated with a particular VHH;
   (b) selecting an association product(s) formed of the VHH and the single-domain antibody on the basis that the single-domain antibody associated with the particular VHH in the step (a) has no binding activity or binding activity of a predetermined value or lower against the antigen; and
   (c) confirming that the single-domain antibody in the association product(s) selected in the step (b) has stronger binding activity against the antigen in a state unassociated with the particular VHH than that in a state associated therewith.
(89) A method for producing a single-domain antibody whose antigen-binding activity can be inhibited by its association with particular VL, by its association with particular VH, or by its association with particular VHH.
(90) The production method according to (89), wherein the method is a method for producing a single-domain antibody whose antigen-binding activity can be inhibited by its association with particular VL.
(91) The production method according to (90), comprising the following step:
   (a) substituting an amino acid residue in a single-domain antibody that is involved in association with antibody VL, to prepare a variant single-domain antibody retaining the binding activity of the single-domain antibody against the target antigen.
(92) The production method according to (91), further comprising the following steps:
   (b) allowing the variant single-domain antibody prepared in the step (a) to be associated with the VL; and
   (c) confirming that the antigen-binding activity of the variant single-domain antibody associated with the VL is weakened as compared with that before the association or lost.
(93) The production method according to (89), wherein the method is a method for producing a single-domain antibody whose antigen-binding activity can be inhibited by its association with particular VH.
(94) The production method according to (93), comprising the following step:
   (a) substituting an amino acid residue in a single-domain antibody that is involved in association with the antibody VH, to prepare a variant single-domain antibody retaining the binding activity of the single-domain antibody against the target antigen.
(95) The production method according to (94), further comprising the following steps:
   (b) allowing the variant single-domain antibody prepared in the step (a) to be associated with the VH; and (c) confirming that the antigen-binding activity of the variant single-domain antibody associated with the VH is weakened as compared with that before the association or lost.
(96) The production method according to (89), wherein the method is a method for producing a single-domain antibody whose antigen-binding activity can be inhibited by its association with particular VHH.
(97) The production method according to (96), comprising the following step:
  (a) substituting an amino acid residue in a single-domain antibody that is involved in association with VHH, to prepare a variant single-domain antibody retaining the binding activity of the single-domain antibody against the target antigen.
(98) The production method according to (97), further comprising the following steps:
  (b) allowing the variant single-domain antibody prepared in the step (a) to be associated with the VHH; and
  (c) confirming that the antigen-binding activity of the variant single-domain antibody associated with the VHH is weakened as compared with that before the association or lost.
(99) A library comprising a plurality of fusion polypeptides of single-domain antibodies each linked to a first association sustaining domain, wherein the single-domain antibodies include a single-domain antibody whose antigen-binding activity can be inhibited or lost by its association with particular VL, a single-domain antibody whose antigen-binding activity can be inhibited or lost by its association with particular VH, or a single-domain antibody whose antigen-binding activity can be inhibited or lost by its association with particular VHH.
(100) The library according to (99), wherein the single-domain antibody moiety in each fusion polypeptide in the library includes a single-domain antibody obtained from an animal of the family Camelidae or a transgenic animal harboring a gene capable of raising the single-domain antibody, or a humanized antibody thereof, a single-domain antibody obtained by the immunization of an animal of the family Camelidae or a transgenic animal harboring a gene capable of raising the single-domain antibody, or a humanized antibody thereof, or an artificially prepared single-domain antibody originating from human antibody VH or VL.
(101) The library according to (99) or (100) which is a library comprising a plurality of fusion polypeptides of single-domain antibodies each linked to a first association sustaining domain, wherein the single-domain antibodies include a single-domain antibody whose antigen-binding activity can be inhibited or lost by its association with particular VL.
(102) The library according to (99) or (100) which is a library comprising a plurality of fusion polypeptides of single-domain antibodies each linked to a first association sustaining domain, wherein the single-domain antibody includes a single-domain antibody whose antigen-binding activity can be inhibited or lost by its association with particular VH.
(103) The library according to (99) or (100) which is a library comprising a plurality of fusion polypeptides of single-domain antibodies each linked to a first association sustaining domain, wherein the single-domain antibody includes a single-domain antibody whose antigen-binding activity can be inhibited or lost by its association with particular VHH.
(104) A method for screening a library according to (99) or (100) for a fusion polypeptide comprising a single-domain antibody whose antigen-binding activity can be inhibited or could lost by its association with particular VL, a single-domain antibody whose antigen-binding activity can be inhibited or lost by its association with particular VH, or a single-domain antibody whose antigen-binding activity can be inhibited or lost by its association with particular VHH.
(105) A method for screening a library according to (101) for a fusion polypeptide comprising a single-domain antibody whose antigen-binding activity can be inhibited or could lost by its association with particular VL.
(106) The screening method according to (105), comprising the following steps:
  (a) allowing the fusion polypeptides of the library to be displayed in vitro;
  (b) providing an association partner of a second association sustaining domain fused with a particular VL;
  (c) allowing each of the fusion polypeptides displayed in the step (a) to be associated with the association partner provided in the step (b) and selecting a fusion polypeptide(s) that does not bind to the antigen or has antigen-binding activity of a predetermined value or lower in a state where the single-domain antibody is associated with the VL; and
  (d) selecting, from the fusion polypeptide(s) thus selected in the step (c), a fusion polypeptide that binds to the antigen or has antigen-binding activity of a predetermined value or higher in a state where the single-domain antibody contained therein is not associated with the VL.
(107) The screening method according to (106), wherein the association partner provided in the step (b) further comprises a protease cleavage sequence, and the step (d) comprises cleaving the association partner by protease treatment so that the association of the single-domain antibody with the VL is canceled.
(108) The screening method according to (107), wherein the protease cleavage sequence of the association partner provided in the step (b) is located near the boundary between the particular VL and the second association sustaining domain.
(109) The screening method according to (106), wherein the fusion polypeptides of the library further comprise a protease cleavage sequence, and the step (d) comprises cleaving the fusion polypeptide(s) by protease treatment so that the association of the single-domain antibody with the VL is canceled.
(110) The screening method according to (109), wherein the protease cleavage sequence contained in each fusion polypeptide is located near the boundary between the single-domain antibody and the first association sustaining domain.
(111) The screening method according to (106), wherein the step (d) comprises allowing the full length of the fusion polypeptide(s) selected in the step (c) or their moieties comprising the single-domain antibodies to be displayed again in vitro.
(112) The screening method according to (106), wherein the step (d) comprises allowing the full length of the fusion polypeptide(s) selected in the step (c) to be displayed again in vitro and selecting a fusion polypeptide that binds to the antigen or has antigen-binding activity of a predetermined value or higher in a state associated only with the second association sustaining domain.
(113) A method for screening a library according to (102) for a fusion polypeptide comprising a single-domain antibody whose antigen-binding activity can be inhibited or could lost by its association with particular VH.
(114) The screening method according to (113), comprising the following steps:
  (a) allowing the fusion polypeptides of the library to be displayed in vitro;
  (b) providing an association partner of a second association sustaining domain fused with a particular VH;
  (c) allowing each of the fusion polypeptides displayed in the step (a) to be associated with the association partner provided in the step (b) and selecting a fusion polypeptide(s) that does not bind to the antigen or has antigen-binding activity of a predetermined value or lower in a state where the single-domain antibody is associated with the VH; and
  (d) selecting, from the fusion polypeptide(s) thus selected in the step (c), a fusion polypeptide that binds to the antigen or has antigen-binding activity of a predetermined value or higher in a state where the single-domain antibody contained therein is not associated with the VH.
(115) The screening method according to (114), wherein the association partner provided in the step (b) further comprises a protease cleavage sequence, and the step (d) comprises cleaving the association partner by protease treatment so that the association of the single-domain antibody with the VH is canceled.
(116) The screening method according to (115), wherein the protease cleavage sequence of the association partner provided in the step (b) is located near the boundary between the particular VH and the second association sustaining domain.
(117) The screening method according to (114), wherein the fusion polypeptides of the library further comprise a protease cleavage sequence, and the step (d) comprises cleaving the fusion polypeptide(s) by protease treatment so that the association of the single-domain antibody with the VH is canceled.
(118) The screening method according to (117), wherein the protease cleavage sequence contained in each fusion polypeptide is located near the boundary between the single-domain antibody and the first association sustaining domain.
(119) The screening method according to (114), wherein the step (d) comprises allowing the full length of the fusion polypeptide(s) selected in the step (c) to be displayed again in vitro or their moieties comprising the single-domain antibodies.
(120) The screening method according to (114), wherein the step (d) comprises allowing the full length of the fusion polypeptide(s) selected in the step (c) displayed again in vitro and selecting a fusion polypeptide that binds to the antigen or has antigen-binding activity of a predetermined value or higher in a state associated only with the second association sustaining domain.
(121) A method for screening a library according to (103) for a fusion polypeptide comprising a single-domain antibody whose antigen-binding activity can be inhibited or could lost by its association with particular VHH.
(122) The screening method according to (121), comprising the following steps:
  (a) allowing the fusion polypeptides of the library to be displayed in vitro;
  (b) providing an association partner of a second association sustaining domain fused with a particular VHH;
  (c) allowing each of the fusion polypeptides displayed in the step (a) to be associated with the association partner provided in the step (b) and selecting a fusion polypeptide(s) that does not bind to the antigen or has antigen-binding activity of a predetermined value or lower in a state where the single-domain antibody is associated with the particular VHH; and
  (d) selecting, from the fusion polypeptide(s) thus selected in the step (c), a fusion polypeptide that binds to the antigen or has antigen-binding activity of a predetermined value or higher in a state where the single-domain antibody contained therein is not associated with the VHH.
(123) The screening method according to (122), wherein the association partner provided in the step (b) further comprises a protease cleavage sequence, and the step (d) comprises cleaving the association partner by protease treatment so that the association of the single-domain antibody with the VHH is canceled.
(124) The screening method according to (123), wherein the protease cleavage sequence of the association partner provided in the step (b) is located near the boundary between the particular VHH and the second association sustaining domain.
(125) The screening method according to (122), wherein the fusion polypeptides of the library further comprise a protease cleavage sequence, and the step (d) comprises cleaving the fusion polypeptide(s) by protease treatment so that the association of the single-domain antibody with the VHH is canceled.
(126) The screening method according to (125), wherein the protease cleavage sequence contained in each fusion polypeptide is located near the boundary between the single-domain antibody and the first association sustaining domain.
(127) The screening method according to (122), wherein the step (d) comprises allowing the full length of the fusion polypeptide(s) selected in the step (c) to be displayed again in vitro or their moieties comprising the single-domain antibodies.
(128) The screening method according to (122), wherein the step (d) comprises allowing the full length of the fusion polypeptide(s) selected in the step (c) to be displayed again in vitro and selecting a fusion polypeptide that binds to the antigen or has antigen-binding activity of a predetermined value or higher in a state associated only with the second association sustaining domain.
(129) The screening method according to any of (106) to (112), (114) to (120), and (122) to (128), wherein the step of providing an association partner in the step (b) is the step of allowing the association partner and the fusion polypeptides to be displayed together.
(130) The library according to any of (99) to (103), wherein the first association sustaining domain comprises an IgG antibody CH1 domain or an antibody light chain constant region.
(131) The screening method according to any of (106) to (112), (114) to (120), and (122) to (128), wherein the first association sustaining domain comprises an IgG antibody CH1 domain, and the second association sustaining domain comprises an antibody light chain constant region.
(132) The screening method according to any of (106) to (112), (114) to (120), and (122) to (128), wherein the first association sustaining domain comprises an antibody light chain constant region, and the second association sustaining domain comprises an IgG antibody CH1 domain.
(133) The screening method according to (105), comprising the following steps:
 (a) allowing the fusion polypeptides of the library to be displayed in vitro;
 (b) providing an association partner of a second association sustaining domain fused with a particular VL;
 (c) selecting a fusion polypeptide(s) comprising a single-domain antibody that binds to the antigen or has antigen-binding activity of a predetermined value or higher; and
 (d) allowing the fusion polypeptide(s) thus selected in the step (c) to be associated with the association partner provided in the step (b) and selecting a fusion polypeptide that does not bind to the antigen or has antigen-binding activity of a predetermined value or lower in a state where the single-domain antibody is associated with the VL.
(134) The screening method according to (129), wherein the step (d) comprises allowing the fusion polypeptides selected in the step (c) to be displayed again in vitro.
(135) The screening method according to (133), wherein the step (c) comprises allowing the fusion polypeptide(s) to be associated only with the second association sustaining domain or confirming the antigen binding of the single-domain antibody contained in the fusion polypeptide associated only with the second association sustaining domain.
(136) The screening method according to (113), comprising the following steps:
 (a) allowing the fusion polypeptides of the library to be displayed in vitro;
 (b) providing an association partner of a second association sustaining domain fused with a particular VH;
 (c) selecting a fusion polypeptide(s) comprising a single-domain antibody that binds to the antigen or has antigen-binding activity of a predetermined value or higher; and
 (d) allowing the fusion polypeptide(s) thus selected in the step (c) to be associated with the association partner provided in the step (b) and selecting a fusion polypeptide that does not bind to the antigen or has antigen-binding activity of a predetermined value or lower in a state where the single-domain antibody is associated with the VH.
(137) The screening method according to (136), wherein the step (d) comprises allowing the fusion polypeptides selected in the step (c) to be displayed again in vitro.
(138) The screening method according to (136), wherein the step (c) comprises allowing the fusion polypeptide to be associated only with the second association sustaining domain or confirming the antigen binding of the single-domain antibody contained in the fusion polypeptide associated only with the second association sustaining domain.
(139) The screening method according to (121), comprising the following steps:
 (a) allowing the fusion polypeptides of the library to be displayed in vitro;
 (b) providing an association partner of a second association sustaining domain fused with a particular VHH;
 (c) selecting a fusion polypeptide(s) comprising a single-domain antibody that binds to the antigen or has antigen-binding activity of a predetermined value or higher; and
 (d) allowing the fusion polypeptide(s) thus selected in the step (c) to be associated with the association partner provided in the step (b) and selecting a fusion polypeptide that does not bind to the antigen or has antigen-binding activity of a predetermined value or lower in a state where the single-domain antibody is associated with the VHH.
(140) The screening method according to (139), wherein the step (d) comprises allowing the fusion polypeptides selected in the step (c) to be displayed again in vitro.
(141) The screening method according to (139), wherein the step (c) comprises allowing the fusion polypeptide(s) to be associated only with the second association sustaining domain or confirming the antigen binding of the single-domain antibody contained in the fusion polypeptide associated only with the second association sustaining domain.
(142) The screening method according to any of (133) to (141), wherein the step of allowing the fusion polypeptide(s) to be associated with the association partner in the step (d) is the step of allowing the association partner and the fusion polypeptides to be displayed together.
(143) The screening method according to any of (133) to (142), wherein the first association sustaining domain comprises an IgG antibody CH1 domain, and the second association sustaining domain comprises an antibody light chain constant region.
(144) The screening method according to any of (133) to (142), wherein the first association sustaining domain comprises an antibody light chain constant region, and the second association sustaining domain comprises an IgG antibody CH1 domain.

Specifically, the present invention may also encompass the following exemplary embodiments.

(B1) A polypeptide comprising an antigen-binding domain and a carrying moiety, wherein the carrying moiety has an inhibiting domain that inhibits the antigen-binding activity of the antigen-binding domain, and wherein the polypeptide has a protease cleavage sequence comprising one or a plurality of sequences selected from the sequences of SEQ ID NOs: 833 to 852 and SEQ ID NOs: 1062 to 1081 and the sequences described in Table 1.
(B2) The polypeptide according to (B1), wherein inhibition of antigen-binding activity of the antigen-binding domain by the inhibiting domain in a state where the protease cleavage sequence has been cleaved by a protease is weaker than the inhibition of antigen-binding activity of the antigen-binding domain by the inhibiting domain under a condition where the protease cleavage sequence is uncleaved.
(B3) The polypeptide according to (B1) or (B2), wherein the antigen-binding domain has a shorter half-life in blood than the carrying moiety.

(B4) The polypeptide according to any one of (B1) to (B3), wherein the molecular weight of the antigen-binding domain is smaller than that of the carrying moiety.

(B5) The polypeptide according to any one of (B1) to (B4), wherein the molecular weight of the antigen-binding domain is 60 kDa or less.

(B6) The polypeptide according to any one of (B1) to (B5), wherein the carrying moiety has FcRn-binding activity, and the antigen-binding domain has no FcRn-binding activity or has weaker FcRn-binding activity than the carrying moiety.

(B7) The polypeptide according to any one of (B1) to (B6), wherein the antigen-binding domain is capable of being released from the polypeptide, and the antigen-binding domain has higher antigen-binding activity in a state where it is released from the polypeptide than antigen-binding activity in a state where it is not released from the polypeptide.

(B8) The polypeptide according to any one of (B1) to (B7), wherein the antigen-binding activity of the antigen-binding domain is inhibited by the association of the inhibiting domain of the carrying moiety with the antigen-binding domain.

(B9) The polypeptide according to (B7), wherein the protease cleavage sequence is cleaved by a protease, so that the antigen-binding domain becomes capable of being released from the polypeptide.

(B10) The polypeptide according to (B8), wherein the protease cleavage sequence is cleaved by a protease, so that the association of the inhibiting domain of the carrying moiety with the antigen-binding domain is canceled.

(B11) The polypeptide according to any one of (B1) to (B10), wherein the protease is a target tissue-specific protease.

(B12) The polypeptide according to (B11), wherein the target tissue is a cancer tissue or an inflammatory tissue, and the protease is a cancer tissue-specific protease or an inflammatory tissue-specific protease.

(B13) The polypeptide according to any one of (B1) to (B12), wherein the protease is at least one protease selected from matriptase, urokinase (uPA), and metalloproteinase.

(B14) The polypeptide according to any one of (B1) to (B12), wherein the protease is at least one protease selected from MT-SP1, uPA, MMP-2, MMP-9, ADAMTS5, MMP-7, and MMP-13.

(B15) The polypeptide according to any one of (B1) to (B14), wherein a first flexible linker is further attached to one end of the protease cleavage sequence.

(B16) The polypeptide according to (B15), wherein the first flexible linker is a flexible linker consisting of a glycine-serine polymer.

(B17) The polypeptide according to (B15) or (B16), wherein a second flexible linker is further attached to the other end of the protease cleavage sequence.

(B18) The polypeptide according to (B17), wherein the second flexible linker is a flexible linker consisting of a glycine-serine polymer.

(B19) The polypeptide according to any one of (B1) to (B18), wherein the antigen-binding domain comprises a single-domain antibody or is a single-domain antibody, wherein the inhibiting domain of the carrying moiety inhibits the antigen-binding activity of the single-domain antibody.

(B20) The polypeptide according to (B19), wherein the single-domain antibody is a VHH, a VH having antigen-binding activity by itself, or a VL having antigen-binding activity by itself.

(B21) The polypeptide according to any one of (B1) to (B20), wherein the antigen-binding domain comprises a single-domain antibody, wherein the inhibiting domain of the carrying moiety is a VHH, an antibody VH, or an antibody VL, and wherein the antigen-binding activity of the single-domain antibody is inhibited by the VHH, the antibody VH, or the antibody VL.

(B22) The polypeptide according to any one of (B1) to (B21), wherein the antigen-binding domain comprises a single-domain antibody, wherein the inhibiting domain of the carrying moiety is a VHH, an antibody VH, or an antibody VL, and wherein the antigen-binding activity of the single-domain antibody is inhibited by its association with the VHH, the antibody VH, or the antibody VL.

(B23) The polypeptide according to any one of (B19) to (B22), wherein the single-domain antibody is a VHH or a VH having antigen-binding activity by itself, wherein the inhibiting domain of the carrying moiety is an antibody VL, and wherein the antigen-binding activity of the VHH or the VH having antigen-binding activity by itself is inhibited by its association with the antibody VL.

(B24) The polypeptide according to any one of (B19) to (B23), wherein the single-domain antibody is a VHH, and wherein the VHH has an amino acid substitution at at least one position selected from amino acids at positions 37, 44, 45, and 47 (all according to Kabat numbering).

(B25) The polypeptide according to any one of (B19) to (B23), wherein the single-domain antibody is a VHH, and wherein the VHH comprises at least one amino acid selected from amino acids 37V, 44G, 45L, and 47W (all according to Kabat numbering).

(B26) The polypeptide according to any one of (B19) to (B23), wherein the single-domain antibody is a VHH, and wherein the VHH comprises at least one amino acid substitution selected from amino acid substitutions F37V, Y37V, E44G, Q44G, R45L, H45L, G47W, F47W, L47W, T47W, and S47W (all according to Kabat numbering).

(B27) The polypeptide according to any one of (B19) to (B23), wherein the single-domain antibody is a VHH, and wherein the VHH has amino acid substitutions at at least one set of positions selected from positions 37/44, positions 37/45, positions 37/47, positions 44/45, positions 44/47, positions 45/47, positions 37/44/45, positions 37/44/47, positions 37/45/47, positions 44/45/47, and positions 37/44/45/47 (all according to Kabat numbering).

(B28) The polypeptide according to any one of (B19) to (B23), wherein the single-domain antibody is a VHH, and wherein the VHH comprises at least one set of amino acids selected from 37V/44G, 37V/45L, 37V/47W, 44G/45L, 44G/47W, 45L/47W, 37V/44G/45L, 37V/44G/47W, 37V/45L/47W, 44G/45L/47W, and 37V/44G/45L/47W (all according to Kabat numbering).

(B29) The polypeptide according to any one of (B19) to (B23), wherein the single-domain antibody is a VHH, and wherein the VHH comprises at least one set of amino acid substitutions selected from F37V/R45L, F37V/G47W, R45L/G47W, and F37V/R45L/G47W (all according to Kabat numbering).

(B30) The polypeptide according to any one of (B19) to (B22), wherein the single-domain antibody is a VL having antigen-binding activity by itself, wherein the inhibiting domain of the carrying moiety is an antibody VH, and wherein the antigen-binding activity of the VL having antigen-binding activity by itself is inhibited by its association with the antibody VH.

(B31) The polypeptide according to any one of (B1) to (B30), wherein the carrying moiety has an FcRn-binding region.

(B32) The polypeptide according to any one of (B1) to (B31), wherein the carrying moiety comprises an antibody constant region.

(B33) The polypeptide according to (B32), wherein the antibody constant region of the carrying moiety and the antigen-binding domain are fused via a linker or without a linker.

(B34) The polypeptide according to (B32), wherein the carrying moiety comprises an antibody heavy chain constant region, and wherein the antibody heavy chain constant region and the antigen-binding domain are fused via a linker or without a linker.

(B35) The polypeptide according to (B32), wherein the carrying moiety comprises an antibody light chain constant region, and wherein the antibody light chain constant region and the antigen-binding domain are fused via a linker or without a linker.

(B36) The polypeptide according to (B34), wherein the N terminus of the antibody heavy chain constant region of the carrying moiety and the C terminus of the antigen-binding domain are fused via a linker or without a linker, and wherein the protease cleavage sequence is located within the sequence of the antigen-binding domain or in the heavy chain antibody constant region on the side closer to the antigen-binding domain beyond the amino acid of position 122 (EU numbering).

(B37) The polypeptide according to (B35), wherein the N terminus of the antibody light chain constant region of the carrying moiety and the C terminus of the antigen-binding domain are fused via a linker or without a linker, and wherein the protease cleavage sequence is located within the sequence of the antigen-binding domain or in the light chain antibody constant region on the side closer to the antigen-binding domain beyond the amino acid of position 113 (EU numbering) (Kabat numbering position 113).

(B38) The polypeptide according to any one of (B33) to (B36), wherein the N terminus of the antibody constant region of the carrying moiety and the C terminus of the antigen-binding domain are fused via a linker or without a linker, wherein the antigen-binding domain is a single-domain antibody prepared from a VH, or is a VHH, and wherein the protease cleavage sequence is located within the sequence of the antibody constant region or in the single-domain antibody of the antigen-binding domain on the side closer to the antibody constant region beyond the amino acid of position 109 (Kabat numbering).

(B39) The polypeptide according to (B33), wherein the N terminus of the antibody constant region of the carrying moiety and the C terminus of the antigen-binding domain are fused via a linker or without a linker, and wherein the protease cleavage sequence is located near the boundary between the antigen-binding domain and the antibody constant region.

(B40) The polypeptide according to (B34), wherein the N terminus of the antibody heavy chain constant region of the carrying moiety and the C terminus of the antigen-binding domain are fused via a linker or without a linker, and wherein the protease cleavage sequence is located near the boundary between the antigen-binding domain and the antibody heavy chain constant region.

(B41) The polypeptide according to (B35), wherein the N terminus of the antibody light chain constant region of the carrying moiety and the C terminus of the antigen-binding domain are fused via a linker or without a linker, and wherein the protease cleavage sequence is located near the boundary between the antigen-binding domain and the antibody light chain constant region.

(B42) The polypeptide according to (B40), wherein the antigen-binding domain is a single-domain antibody prepared from a VH, or is a VHH, and wherein the protease cleavage sequence is located between the amino acid of position 109 (Kabat numbering) of the single-domain antibody of the antigen-binding domain and the amino acid of position 122 (EU numbering) of the antibody heavy chain constant region.

(B43) The polypeptide according to (B41), wherein the antigen-binding domain is a single-domain antibody prepared from a VH, or is a VHH, and wherein the protease cleavage sequence is located between the amino acid of position 109 (Kabat numbering) of the single-domain antibody of the antigen-binding domain and the amino acid of position 113 (EU numbering) (Kabat numbering position 113) of the antibody light chain constant region.

(B44) The polypeptide according to (B40), wherein the antigen-binding domain is a single-domain antibody prepared from a VL, and wherein the protease cleavage sequence is located between the amino acid of position 104 (Kabat numbering) of the single-domain antibody of the antigen-binding domain and the amino acid of position 122 (EU numbering) of the antibody heavy chain constant region.

(B45) The polypeptide according to (B41), wherein the antigen-binding domain is a single-domain antibody prepared from a VL, and wherein the protease cleavage sequence is located between the amino acid of position 109 (Kabat numbering) of the single-domain antibody of the antigen-binding domain and the amino acid of position 113 (EU numbering) (Kabat numbering position 113) of the antibody light chain constant region.

(B46) The polypeptide according to any one of (B32) to (B45), wherein the antibody constant region of the polypeptide is an IgG antibody constant region.

(B47) The polypeptide according to any one of (B1) to (B46), wherein the polypeptide is an IgG antibody-like molecule.

(B48) The polypeptide according to any one of (B1) to (B47), wherein when the antigen-binding domain is assayed in an unreleased state by using a bio-layer interferometry (BLI) (Octet), the binding of the antigen-binding domain to the antigen is not seen.

(B49) The polypeptide according to any one of (B1) to (B48), wherein a second antigen-binding domain is further linked to the antigen-binding domain.

(B50) The polypeptide according to (B49), wherein the second antigen-binding domain has antigen-binding specificity different from that of the antigen-binding domain.

(B51) The polypeptide according to (B49) or (B50), wherein the second antigen-binding domain comprises a second single-domain antibody.

(B52) The polypeptide according to (B51), wherein the antigen-binding domain is a single-domain antibody, wherein the second antigen-binding domain is a second single-domain antibody, wherein the antigen-binding domain and the second antigen-binding domain are capable of being released from the polypeptide, and wherein the single-domain antibody and the second single-domain antibody form a bispecific antigen-binding molecule in a state where the antigen-binding domain and the second antigen-binding domain are released.

(B53) The polypeptide according to any one of (B49) to (B52), wherein the second antigen-binding domain is directed to HER2 or GPC3 as a target antigen.

(B54) The polypeptide according to any one of (B1) to (B53), wherein the polypeptide further has an additional antigen-binding domain different from the antigen-binding domain, and wherein the antigen-binding activity of the additional antigen-binding domain is also inhibited by its linkage to the carrying moiety of the polypeptide.

(B55) The polypeptide according to (B54), wherein the additional antigen-binding domain and the antigen-binding domain have different antigen-binding specificities.

(B56) The polypeptide according to any one of (B1) to (B55), wherein the antigen-binding domain is an antigen-binding domain directed to Plexin A1, IL-6R, or CD3 as a target antigen.

(B57) A pharmaceutical composition comprising the polypeptide of any one of (B1) to (B56).

(B58) A method for producing the polypeptide of any one of (B1) to (B56).

(B59) The production method according to (B58), comprising the steps of:
  (a) obtaining a single-domain antibody binding to a target antigen;
  (b) linking the single-domain antibody obtained in step (a) to a carrying moiety such that the antigen-binding activity of the single-domain antibody is inhibited by an inhibiting domain of the carrying moiety, to form a polypeptide precursor; and
  (c) introducing a protease cleavage sequence into the polypeptide precursor.

(B60) The production method according to (B58), comprising the steps of:
  (a) obtaining a single-domain antibody binding to a target antigen;
  (b) linking the single-domain antibody obtained in step (a) to a carrying moiety such that the antigen-binding activity of the single-domain antibody is inhibited by an inhibiting domain of the carrying moiety, to form a polypeptide precursor; and
  (c) introducing a protease cleavage sequence to near the boundary between the single-domain antibody and the carrying moiety, wherein the protease cleavage sequence comprises one or a plurality of sequences selected from the sequences of SEQ ID NOs: 833 to 852 and SEQ ID NOs: 1062 to 1081 and the sequences described in Table 1.

(B61) The production method according to (B58), comprising the steps of:
  (a) obtaining a single-domain antibody binding to a target antigen; and
  (b) linking the single-domain antibody obtained in step (a) to a carrying moiety via a protease cleavage sequence such that the antigen-binding activity of the single-domain antibody is inhibited by an inhibiting domain of the carrying moiety, to form a polypeptide, wherein the protease cleavage sequence comprises one or a plurality of sequences selected from the sequences of SEQ ID NOs: 833 to 852 and SEQ ID NOs: 1062 to 1081 and the sequences described in Table 1.

(B62) The production method according to any one of (B59) to (B61), further comprising the step of:
  (d) confirming that the binding activity of the single-domain antibody harboring the polypeptide or the polypeptide precursor against the target antigen is weakened or lost.

(B63) The production method according to any one of (B59) to (B62), further comprising the step of:
  (e) releasing the single-domain antibody by cleaving the protease cleavage sequence with a protease and confirming that the released single-domain antibody binds to the antigen.

(B64) The production method according to (B58), wherein the polypeptide is an IgG antibody-like molecule.

(B65) The production method according to (B64), comprising the steps of:
  (a) obtaining a single-domain antibody binding to a target antigen;
  (b) allowing the single-domain antibody obtained in step (a) to be associated with a VL as a substitute for a VH of an IgG antibody or allowing the single-domain antibody to be associated with a VH as a substitute for a VL of an IgG antibody, such that the antigen-binding activity of the single-domain antibody is inhibited, to form an IgG antibody-like molecule precursor harboring the single-domain antibody; and
  (c) introducing a protease cleavage sequence into the IgG antibody-like molecule precursor harboring the single-domain antibody, wherein the protease cleavage sequence comprises one or a plurality of sequences selected from the sequences of SEQ ID NOs: 833 to 852 and SEQ ID NOs: 1062 to 1081 and the sequences described in Table 1.

(B66) The production method according to (B64), comprising the steps of:
  (a) obtaining a single-domain antibody binding to a target antigen;
  (b) allowing the single-domain antibody obtained in step (a) to be associated with a VL as a substitute for a VH of an IgG antibody or allowing the single-domain antibody to be associated with a VH as a substitute for a VL of an IgG antibody, such that the antigen-binding activity of the single-domain antibody is inhibited, to form an IgG antibody-like molecule precursor harboring the single-domain antibody; and
  (c) introducing a protease cleavage sequence to near the boundary between the single-domain antibody and an antibody constant region in the IgG antibody-like molecule precursor, wherein the protease cleavage sequence comprises one or a plurality of sequences selected from the sequences of SEQ ID NOs: 833 to 852 and SEQ ID NOs: 1062 to 1081 and the sequences described in Table 1.

(B67) The production method according to (B64), comprising the steps of:
  (a) obtaining a single-domain antibody binding to a target antigen; and
  (b) linking the single-domain antibody obtained in step (a) as a substitute for an IgG antibody VH or VL to an IgG antibody heavy chain constant region or light chain constant region via a protease cleavage sequence such that the antigen-binding activity of the single-domain antibody is inhibited, to form an IgG antibody-like molecule harboring the single-domain antibody, wherein the protease cleavage sequence comprises one or a plurality of sequences selected from the sequences of SEQ ID NOs: 833 to 852 and SEQ ID NOs: 1062 to 1081 and the sequences described in Table 1.
(B68) The production method according to any one of (B65) to (B67), further comprising the step of:
  (d) confirming that the binding activity of the single-domain antibody introduced into the IgG antibody-like molecule or into the IgG antibody-like molecule precursor against the target antigen is weakened or lost.
(B69) The production method according to any one of (B65) to (B68), further comprising the step of:
  (e) releasing the single-domain antibody by cleaving the protease cleavage sequence with a protease and confirming that the released single-domain antibody binds to the target antigen.
(B70) The production method according to (B64), comprising the steps of:
  (a) substituting an amino acid residue in a single-domain antibody that is involved in the association with an antibody VH, or substituting an amino acid residue in a single-domain antibody that is involved in the association with an antibody VL, to prepare a variant single-domain antibody retaining the binding activity of the single-domain antibody against the target antigen;
  (b) allowing the variant single-domain antibody prepared in step (a) to be associated with an antibody VH or by allowing the variant single-domain antibody to be associated with an antibody VL, such that the antigen-binding activity of the variant single-domain antibody is inhibited to form an IgG antibody-like molecule precursor harboring the variant single-domain antibody; and
  (c) introducing a protease cleavage sequence into the IgG antibody-like molecule precursor harboring the variant single-domain antibody, wherein the protease cleavage sequence comprises one or a plurality of sequences selected from the sequences of SEQ ID NOs: 833 to 852 and SEQ ID NOs: 1062 to 1081 and the sequences described in Table 1.
(B71) The production method according to (B64), comprising the steps of:
  (a) substituting an amino acid residue in a single-domain antibody that is involved in the association with an antibody VH or substituting an amino acid residue in a single-domain antibody that is involved in the association with an antibody VL, to prepare a variant single-domain antibody retaining the binding activity of the single-domain antibody against the target antigen;
  (b) allowing the variant single-domain antibody prepared in step (a) to be associated with an antibody VH or allowing the variant single-domain antibody to be associated with an antibody VL, such that the antigen-binding activity of the variant single-domain antibody is inhibited, to form an IgG antibody-like molecule precursor harboring the variant single-domain antibody; and
  (c) introducing a protease cleavage sequence to near the boundary between the variant single-domain antibody and a constant region in the IgG antibody-like molecule precursor, wherein the protease cleavage sequence comprises one or a plurality of sequences selected from the sequences of SEQ ID NOs: 833 to 852 and SEQ ID NOs: 1062 to 1081 and the sequences described in Table 1.
(B72) The production method according to (B64), comprising the steps of:
  (a) substituting an amino acid residue in a single-domain antibody that is involved in the association with an antibody VH or substituting an amino acid residue in a single-domain antibody that is involved in the association with an antibody VL, to prepare a variant single-domain antibody retaining the binding activity of the single-domain antibody against the target antigen; and
  (b) linking the variant single-domain antibody prepared in step (a) to an IgG antibody heavy chain constant region via a protease cleavage sequence or linking the variant single-domain antibody to an IgG antibody light chain constant region via a protease cleavage sequence, such that the antigen-binding activity of the variant single-domain antibody is inhibited, to form an IgG antibody-like molecule harboring the variant single-domain antibody, wherein the protease cleavage sequence comprises one or a plurality of sequences selected from the sequences of SEQ ID NOs: 833 to 852 and SEQ ID NOs: 1062 to 1081 and the sequences described in Table 1.
(B73) The production method according to any one of (B70) to (B72), further comprising the step of:
  (d) confirming that the binding activity of the variant single-domain antibody introduced into the IgG antibody-like molecule or into the IgG antibody-like molecule precursor against the target antigen is weakened or lost.
(B74) The production method according to any one of (B70) to (B73), further comprising the step of:
  (e) releasing the variant single-domain antibody by cleaving the protease cleavage sequence with a protease and confirming that the released variant single-domain antibody binds to the target antigen.
(B75) A polynucleotide encoding the polypeptide of any one of (B1) to (B56).
(B76) A vector comprising the polynucleotide of (B75).
(B77) A host cell comprising the polynucleotide of (B75) or the vector of (B76).
(B78) A method for producing the polypeptide of any one of (B1) to (B56), comprising the step of culturing the host cell of (B77).

BRIEF DESCRIPTION OF DRAWINGS

FIG. 1 is a diagram showing the concept of Probody technology. The Probody is an antibody molecule whose antigen-binding activity is inhibited by linkage of an antibody to a peptide masking the antigen-binding site of the antibody via a linker that is cleaved by protease expressed at a lesion site.

FIG. 8(A) is a diagram showing the polypeptide in an unreleased state. The antigen-binding activity of the antigen-binding domain is inhibited. FIG. 8(B) is a diagram showing the release of the bispecific antigen-binding molecule formed by the antigen-binding domain and the second antigen-binding domain. FIG. 8(C) is a diagram showing a bispecific antigen-binding molecule against, for example, a T cell surface antigen and a cancer cell surface antigen, as an example of the bispecific antigen-binding molecule after the release.

FIG. 9A(1) is a diagram showing the library comprising a plurality of fusion polypeptides of single-domain antibodies each linked to a first association sustaining domain. FIG. 9A(2) is a diagram showing that the antigen-binding activity of each single-domain antibody is confirmed in a state where the fusion polypeptide is associated with an association partner. A fusion polypeptide comprising a single-domain antibody that does not bind to the target antigen or has antigen-binding activity of a predetermined value or lower in this state of association is selected. FIG. 9A(3) is a diagram showing that the association of the single-domain antibody in the fusion polypeptide selected in (2) with the inhibiting domain in the association partner is canceled, and the antigen-binding activity of the single-domain antibody is confirmed. A fusion polypeptide comprising a single-domain antibody that binds to the target antigen or has antigen-binding activity of a predetermined value or higher in this state of non-association is selected. FIG. 9A(2') is a diagram showing that the antigen-binding activity of the single-domain antibody in each fusion polypeptide is confirmed. A fusion polypeptide comprising a single-domain antibody that binds to the target antigen or has antigen-binding activity of a predetermined value or higher in this state of the fusion polypeptide existing alone is selected. FIG. 9A(3') is a diagram showing that the antigen-binding activity of the single-domain antibody is confirmed in a state where the fusion polypeptide selected in (2') is associated with an association partner. A fusion polypeptide comprising a single-domain antibody that does not bind to the target antigen or has antigen-binding activity of a predetermined value or lower in this state of association is selected.

FIG. 11(A) is a diagram showing antibody-like molecule model prepared by inserting a protease cleavage sequence near the boundary between VHH and the constant region in IL6R90-G1m. FIG. 11(B) is a diagram showing the name of each prepared antibody heavy chain, the insertion site of the amino acid sequence, and the inserted amino acid sequence. The insertion site is indicated by [insert].

FIG. 12-1 is a diagram showing results of evaluating the degree of cleavage by reducing SDS-PAGE after protease (MT-SP1) treatment of IL6R90-G1m or antibody-like molecules prepared by inserting a protease cleavage sequence near the boundary between VHH and the constant region in IL6R90-G1m. Of two new bands resulting from the protease treatment, the band appearing at 25 kDa or smaller is a band derived from the VHH, and the band appearing at a position of 25 to 50 kDa is a band derived from the constant region.

FIG. 12-2 is a diagram continued from FIG. 12-1.

DESCRIPTION OF EMBODIMENTS

Figure 2:
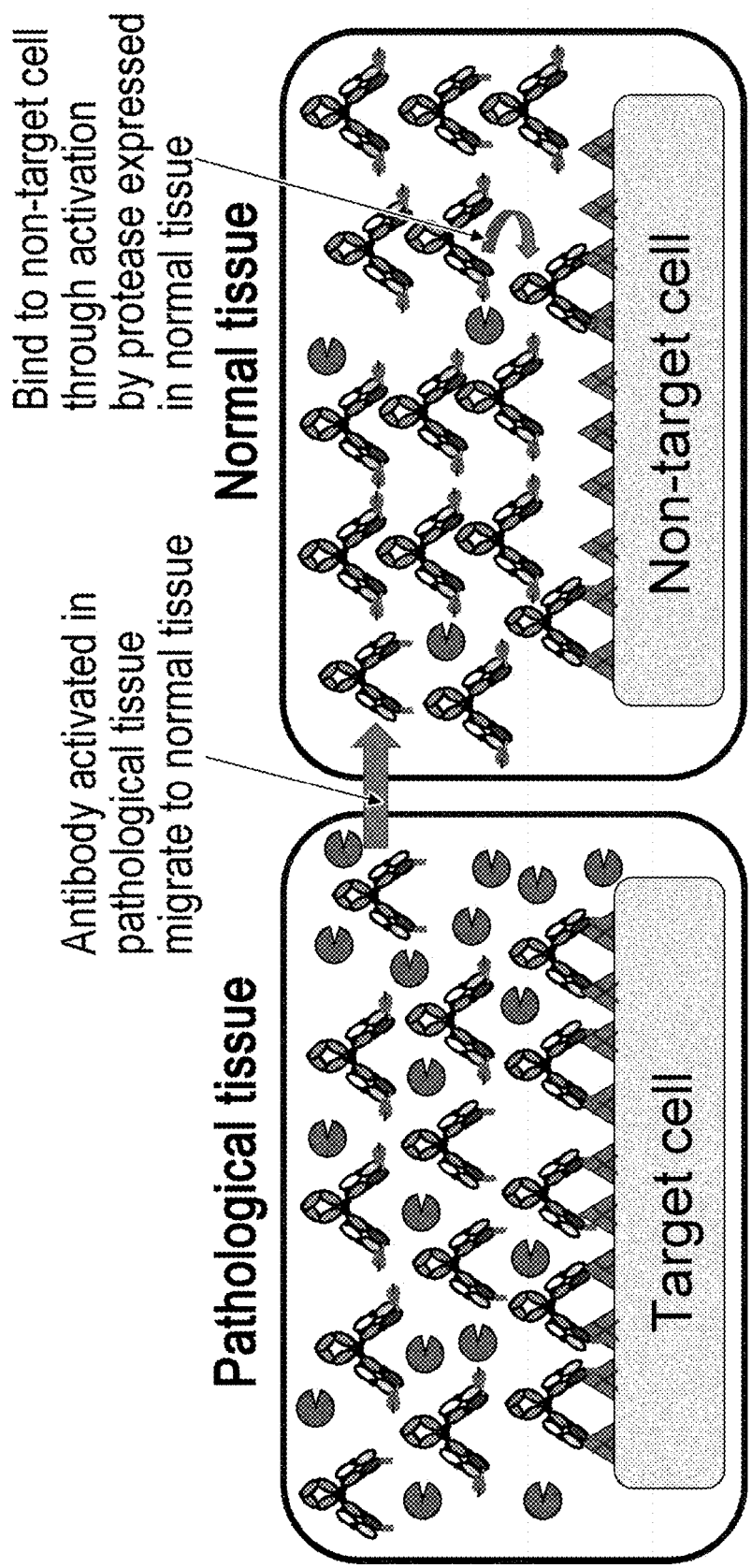
FIG. 2 is a diagram showing a cause of side effects that might be exhibited by Probody. Activated Probody accumulated in blood might exhibit side effects by binding to an antigen expressed in a normal tissue.

The polypeptide according to the present invention usually refers to a peptide having a length on the order of 4 amino acids or longer, and a protein. Also, the polypeptide according to the present invention is usually a polypeptide consisting of an artificially designed sequence, but is not particularly limited thereto. For example, an organism-derived polypeptide may be used. Alternatively, the polypeptide according to the present invention may be any of a natural polypeptide, a synthetic polypeptide, a recombinant polypeptide, and the like. Furthermore, fragments of these polypeptides are also included in the polypeptide of the present invention.

In the present specification, each amino acid is indicated by one-letter code or three-letter code, or both, as represented by, for example, Ala/A, Leu/L, Arg/R, Lys/K, Asn/N, Met/M, Asp/D, Phe/F, Cys/C, Pro/P, Gln/Q, Ser/S, Glu/E, Thr/T, Gly/G, Trp/W, His/H, Tyr/Y, Ile/I, or Val/V. For expressing an amino acid located at a particular position, an expression using a number representing the particular position in combination with the one-letter code or the three-letter code of the amino acid can be appropriately used. For example, an amino acid 37V, which is an amino acid contained in a single-domain antibody, represents Val located at position 37 defined by the Kabat numbering.

For the alteration of an amino acid in the amino acid sequence of a polypeptide, a method known in the art such as site-directed mutagenesis (Kunkel et al. (Proc. Natl. Acad. Sci. USA (1985) 82, 488-492)) or overlap extension PCR can be appropriately adopted. A plurality of methods known in the art can also be adopted as alteration methods for substituting an amino acid by an amino acid other than a natural amino acid (Annu. Rev. Biophys. Biomol. Struct. (2006) 35, 225-249; and Proc. Natl. Acad. Sci. U.S.A. (2003) 100 (11), 6353-6357). For example, a tRNA-containing cell-free translation system (Clover Direct (Protein Express)) having a non-natural amino acid bound with amber suppressor tRNA complementary to UAG codon (amber codon), which is a stop codon, is also preferably used. In the present specification, examples of the alteration include, but are not limited to, substitution.

In the present specification, the term "and/or" used to represent amino acid alteration sites is meant to include every combination appropriately represented by "and" and "or". Specifically, for example, the phrase "amino acids at positions 37, 45, and/or 47 are substituted" includes the following variations of amino acid alteration:
- (a) position 37, (b) position 45, (c) position 47, (d) positions 37 and 45, (e) positions 37 and 47, (f) positions 45 and 47, and (g) positions 37, 45 and 47.

In the present specification, expression in which the one-letter codes or three-letter-codes of amino acids before and after alteration are used previous and next to a number representing a particular position can be appropriately used for representing amino acid alteration. For example, an alteration F37V or Phe37Val used for substituting an amino acid contained in an antibody variable region or a single-domain antibody represents the substitution of Phe at position 37 defined by the Kabat numbering by Val. Specifically, the number represents an amino acid position defined by the Kabat numbering; the one-letter code or three-letter code of the amino acid previous to the number represents the amino acid before the substitution; and the one-letter code or three-letter code of the amino acid next to the number represents the amino acid after the substitution. Likewise, an alteration P238A or Pro238Ala used for substituting an amino acid in a Fc region contained in an antibody constant region represents the substitution of Pro at position 238 defined by the EU numbering by Ala. Specifically, the number represents an amino acid position defined by the EU numbering; the one-letter code or three-letter code of the amino acid previous to the number represents the amino acid before the substitution; and the one-letter code or three-letter code of the amino acid next to the number represents the amino acid after the substitution.

In the present specification, the term "antibody" is used in the broadest sense and encompasses various antibody structures including, but are not limited to, a monoclonal antibody, a polyclonal antibody, a multispecific antibody (e.g., a bispecific antibody), a single-domain antibody, and an antibody fragment as long as the antibody exhibits the desired antigen-binding activity.

The "antibody fragment" refers to a molecule other than an intact antibody that comprises a portion of an intact antibody that binds the antigen to which the intact antibody binds. Examples of the antibody fragments include but are not limited to, Fv, Fab, Fab', Fab'-SH, F(ab')2, diabodies, linear antibodies, single-chain antibody molecules (e.g., scFv), and multispecific antibodies formed from antibody fragments.

The terms "full-length antibody", "intact antibody", and "whole antibody" are used herein interchangeably to refer to an antibody having a structure substantially similar to a native antibody structure or having heavy chains that contain a Fc region as defined herein.

The term "variable region" or "variable domain" refers to a region or a domain of an antibody heavy chain or light chain involved in the binding of the antibody to its antigen. Usually, antibody heavy chain and light chain variable domains (VH and VL, respectively) are structurally similar and each contain 4 conserved framework regions (FRs) and 3 complementarity determining regions (CDRs) (see e.g., Kindt et al., Kuby Immunology, 6th ed., W.H. Freeman and Co., page 91 (2007)). One VH or VL domain may suffice for conferring antigen-binding specificity.

The term "complementarity determining region" or "CDR" used in the present specification is hypervariable in the sequence, and/or forms a structurally determined loop ("hypervariable loop"), and/or refers to antigen contact residues ("antigen contacts") or each region of an antibody variable domain. Usually, an antibody contains 6 CDRs: three in VH (H1, H2, and H3), and three in VL (L1, L2, and L3). In the present specification, exemplary CDRs include the following:
- (a) hypervariable loops occurring at amino acid residues 26 to 32 (L1), 50 to 52 (L2), 91 to 96 (L3), 26 to 32 (H1), 53 to 55 (H2), and 96 to 101 (H3) (Chothia and Lesk, J. Mol. Biol. 196: 901-917 (1987));
- (b) CDRs occurring at amino acid residues 24 to 34 (L1), 50 to 56 (L2), 89 to 97 (L3), 31 to 35b (H1), 50 to 65 (H2), and 95 to 102 (H3) (Kabat et al., Sequences of Proteins of Immunological Interest, 5th Ed. Public Health Service, National Institutes of Health, Bethesda, MD (1991));
- (c) antigen contacts occurring at amino acid residues 27c to 36 (L1), 46 to 55 (L2), 89 to 96 (L3), 30 to 35b (H1), 47 to 58 (H2), and 93 to 101 (H3) (MacCallum et al., J. Mol. Biol. 262: 732-745 (1996)); and
- (d) a combination of (a), (b), and/or (c) containing HVR amino acid residues 46 to 56 (L2), 47 to 56 (L2), 48 to 56 (L2), 49 to 56 (L2), 26 to 35 (H1), 26 to 35b (H1), 49 to 65 (H2), 93 to 102 (H3), and 94 to 102 (H3).

Generally, a single-domain antibody comprises three CDRs: CDR1, CDR2, and CDR3. When a single-domain antibody is a single-domain antibody prepared from a VHH or an antibody VH, the single-domain antibody CDRs exemplarily include the following:
- (a) hypervariable loops occurring at amino acid residues 26 to 32 (CDR1), 53 to 55 (CDR2), and 96 to 101 (CDR3) (Chothia and Lesk, J. Mol. Biol. 196: 901-917 (1987));
- (b) CDRs occurring at amino acid residues 31 to 35b (CDR1), 50 to 65 (CDR2), and 95 to 102 (CDR3) (Kabat et al., Sequences of Proteins of Immunological Interest, 5th Ed. Public Health Service, National Institutes of Health, Bethesda, MD (1991));
- (c) antigen contacts occurring at amino acid residues 30 to 35b (CDR1), 47 to 58 (CDR2), and 93 to 101 (CDR3) (MacCallum et al., J. Mol. Biol. 262: 732-745 (1996)); and
- (d) a combination of (a), (b), and/or (c), including CDR amino acid residues 26 to 35 (CDR1), 26 to 35b (CDR1), 49 to 65 (CDR2), 93 to 102 (CDR3), or 94 to 102 (CDR3).

When the single-domain antibody is a single-domain antibody prepared from an antibody VL, the single-domain antibody CDRs exemplarily include the following:
- (a) hypervariable loops occurring at amino acid residues 26 to 32 (CDR1), 50 to 52 (CDR2), and 91 to 96 (CDR3) (Chothia and Lesk, J. Mol. Biol. 196: 901-917 (1987));
- (b) CDRs occurring at amino acid residues 24 to 34 (CDR1), 50 to 56 (CDR2), and 89 to 97 (CDR3) (Kabat et al., Sequences of Proteins of Immunological Interest, 5th Ed. Public Health Service, National Institutes of Health, Bethesda, MD (1991));
- (c) antigen contacts occurring at amino acid residues 27c to 36 (CDR1), 46 to 55 (CDR2), and 89 to 96 (CDR3) (MacCallum et al., J. Mol. Biol. 262: 732-745 (1996)); and (d) a combination of (a), (b), and/or (c), including CDR amino acid residues 46 to 56 (CDR2), 47 to 56 (CDR2), 48 to 56 (CDR2), or 49 to 56 (CDR2).

In the present specification, CDR residues and other residues (e.g., FR residues) in a variable domain are numbered according to Kabat et al. (supra), unless otherwise specified.

The term "framework" or "FR" refers to variable domain residues other than complementarity determining region (CDR) residues. FRs in a variable domain generally consist of 4 FR domains: FR1, FR2, FR3, and FR4. Accordingly, the sequences of CDRs and FRs usually appear in VH (or VL) in the following order: FR1-H1 (L1)-FR2-H2 (L2)-FR3-H3 (L3)-FR4. In a single-domain antibody, the sequences of CDRs and FRs generally appear in the following order: FR1-CDR1-FR2-CDR2-FR3-CDR3-FR4.

Generally, a single-domain antibody of the present invention can be defined as a polypeptide comprising the following:

a) an amino acid sequence consisting of four framework regions/sequences having three complementarity determining regions/sequences inserted there between (the amino acid residue at position 11 according to Kabat numbering is selected from the group consisting of L, M, S, V, and W, and is preferably L); and/or b) an amino acid sequence consisting of four framework regions/sequences having three complementarity determining regions/sequences inserted there between (the amino acid residue at position 37 according to Kabat numbering is selected from the group consisting of F, Y, H, I, L, and V, and is preferably F or Y); and/or c) an amino acid sequence consisting of four framework regions/sequences having three complementarity determining regions/sequences inserted there between (the amino acid residue at position 44 according to Kabat numbering is selected from the group consisting of G, E, A, D, Q, R, S, and L, is preferably G, E, or Q, and is more preferably G or E); and/or d) an amino acid sequence consisting of four framework regions/sequences having three complementarity determining regions/sequences inserted there between (the amino acid residue at position 45 according to Kabat numbering is selected from the group consisting of L, R, C, I, L, P, Q, and V, and is preferably L or R); and/or e) an amino acid sequence consisting of four framework regions/sequences having three complementarity determining regions/sequences inserted there between (the amino acid residue at position 47 according to Kabat numbering is selected from the group consisting of W, L, F, A, G, I, M, R, S, V, and Y, and is preferably W, L, F or R); and/or f) an amino acid sequence consisting of four framework regions/sequences having three complementarity determining regions/sequences inserted there between (the amino acid residue at position 83 according to Kabat numbering is selected from the group consisting of R, K, N, E, G, I, M, Q, and T, is preferably K or R, and is more preferably K); and/or g) an amino acid sequence consisting of four framework regions/sequences having three complementarity determining regions/sequences inserted there between (the amino acid residue at position 84 according to Kabat numbering is selected from the group consisting of P, A, L, R, S, T, D, and V, and is preferably P); and/or h) an amino acid sequence consisting of four framework regions/sequences having three complementarity determining regions/sequences inserted there between (the amino acid residue at position 103 according to Kabat numbering is selected from the group consisting of W, P, R, and S, and is preferably W); and/or i) an amino acid sequence consisting of four framework regions/sequences having three complementarity determining regions/sequences inserted there between (the amino acid residue at position 104 according to Kabat numbering is G or D, and is preferably G); and/or j) an amino acid sequence consisting of four framework regions/sequences having three complementarity determining regions/sequences inserted there between (the amino acid residue at position 108 according to Kabat numbering is selected from the group consisting of Q, L, and R, and is preferably Q or L).

More specifically but not exclusively, a single-domain antibody of the present invention can be defined as a polypeptide comprising any one of the amino acid sequences consisting of four framework regions/sequences having three complementarity determining regions/sequences inserted therebetween:

k) an amino acid sequence in which the amino acid residues at positions 43 to 46 according to Kabat numbering are KERE or KQRE;

l) an amino acid sequence in which the amino acid residues at positions 44 to 47 according to Kabat numbering are GLEW; and m) an amino acid sequence in which the amino acid residues at positions 83 to 84 according to Kabat numbering are KP or EP.

In the present specification, the term "constant region" or "constant domain" refers to a region or a domain other than variable regions in an antibody. For example, an IgG antibody is a heterotetrameric glycoprotein of approximately 150,000 Da constituted by two identical light chains and two identical heavy chains connected through disulfide bonds. Each heavy chain has a variable region (VH) also called variable heavy chain domain or heavy chain variable domain, followed by a heavy chain constant region (CH) containing a CH1 domain, a hinge region, a CH2 domain, and a CH3 domain, from the N terminus toward the C terminus. Likewise, each light chain has a variable region (VL) also called variable light chain domain or light chain variable domain, followed by a constant light chain (CL) domain, from the N terminus toward the C terminus. The light chains of native antibodies may be attributed to one of two types called kappa (c) and lambda (a) on the basis of the amino acid sequences of their constant domains.

In the present specification, the term "Fc region" herein is used to define a C-terminal region of an immunoglobulin heavy chain that contain at least a portion of the constant region. The term includes native sequence Fc regions and variant Fc regions. In one embodiment, a human IgG1 Fc region extends from Cys226, or from Pro230, to the carboxyl-terminus of the heavy chain. However, the C-terminal lysine (Lys447) or glycine-lysine (Gly446-Lys447) of the Fc region may or may not be present. Unless otherwise specified herein, numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, M D 1991.

The "class" of an antibody refers to the type of constant domain or constant region possessed by its heavy chain. There are five major classes of antibodies: IgA, IgD, IgE, IgG, and IgM, and several of these may be further divided into subclasses (isotypes), e.g., $IgG_1$, $IgG_2$, $IgG_3$, $IgG_4$, IgA$_1$, and IgA$_2$. The heavy chain constant domains that correspond to the different classes of immunoglobulins are called α, δ, ε, γ, and μ, respectively.

In the present specification, the "antigen-binding domain" is limited only by binding to the antigen of interest. The antigen-binding domain can be a domain having any structure as long as the domain used binds to the antigen of interest. Examples of such a domain include, but are not limited to, an antibody heavy chain variable region (VH), an antibody light chain variable region (VL), a single-domain antibody (sdAb), a module called A domain of approximately 35 amino acids contained in an in vivo cell membrane protein avimer (WO2004/044011 and WO2005/040229), adnectin containing a 10Fn3 domain serving as a protein binding domain derived from a glycoprotein fibronectin expressed on cell membranes (WO2002/032925), Affibody containing an IgG binding domain scaffold constituting a three-helix bundle composed of 58 amino acids of protein A (WO1995/001937), DARPins (designed ankyrin repeat proteins) which are molecular surface-exposed regions of ankyrin repeats (AR) each having a 33-amino acid residue structure folded into a subunit of a turn, two antiparallel helices, and a loop (WO2002/020565), anticalin having four loop regions connecting eight antiparallel strands bent toward the central axis in one end of a barrel structure highly conserved in lipocalin molecules such as neutrophil gelatinase-associated lipocalin (NGAL) (WO2003/029462), and a depressed region in the internal parallel sheet structure of a horseshoe-shaped fold composed of repeated leucine-rich-repeat (LRR) modules of an immunoglobulin structure-free variable lymphocyte receptor (VLR) as seen in the acquired immune systems of jawless vertebrates such as lamprey or hagfish (WO2008/016854).

Preferred examples of the antigen-binding domain of the present invention include an antigen-binding domain that can exert an antigen binding function by a molecule constituted only by the antigen-binding domain, and an antigen-binding domain that can exert an antigen binding function by itself after being released from an additional peptide linked thereto. Examples of such an antigen-binding domain include, but are not limited to, single-domain antibodies, scFv, Fv, Fab, Fab', and F(ab')2.

One preferred example of the antigen-binding domain of the present invention includes an antigen-binding domain having a molecular weight of 60 kDa or smaller. Examples of such an antigen-binding domain include, but are not limited to, single-domain antibodies, scFv, Fab, and Fab'. The antigen-binding domain having a molecular weight of 60 kDa or smaller is usually likely to be subjected to clearance by the kidney when existing as a monomer in blood (see J Biol Chem. 1988 Oct. 15; 263 (29): 15064-70).

From another viewpoint, one preferred example of the antigen-binding domain of the present invention includes an antigen-binding domain having a half-life in blood of 12 hours or shorter. Examples of such an antigen-binding domain include, but are not limited to, single-domain antibodies, scFv, Fab, and Fab'.

One preferred example of the antigen-binding domain of the present invention includes a single-domain antibody (sdAb).

In the present specification, the term "single-domain antibody" is not limited by its structure as long as the domain can exert antigen-binding activity by itself. It is known that a general antibody, for example, an IgG antibody, exhibits antigen-binding activity in a state where a variable region is formed by the pairing of VH and VL, whereas the own domain structure of the single-domain antibody can exert antigen-binding activity by itself without pairing with another domain. Usually, the single-domain antibody has a relatively low molecular weight and exists in the form of a monomer.

Examples of the single-domain antibody include, but are not limited to, antigen-binding molecules congenitally lacking a light chain, such as VHH of an animal of the family Camelidae and shark VNAR, and antibody fragments containing the whole or a portion of an antibody VH domain or the whole or a portion of an antibody VL domain. Examples of the single-domain antibody which is an antibody fragment containing the whole or a portion of an antibody VH or VL domain include, but are not limited to, artificially prepared single-domain antibodies originating from human antibody VH or human antibody VL as described in U.S. Pat. No. 6,248,516 B1, etc. In some embodiments of the present invention, one single-domain antibody has three CDRs (CDR1, CDR2 and CDR3).

The single-domain antibody can be obtained from an animal capable of producing the single-domain antibody or by the immunization of the animal capable of producing the single-domain antibody. Examples of the animal capable of producing the single-domain antibody include, but are not limited to, animals of the family Camelidae, and transgenic animals harboring a gene capable of raising the single-domain antibody. The animals of the family Camelidae include camels, lamas, alpacas, one-hump camels and guanacos, etc. Examples of the transgenic animals harboring a gene capable of raising the single-domain antibody include, but are not limited to, transgenic animals described in WO2015/143414 and U.S. Patent Publication No. US2011/0123527 A1. The framework sequences of the single-domain antibody obtained from the animal may be converted to human germline sequences or sequences similar thereto to obtain a humanized single-domain antibody. The humanized single-domain antibody (e.g., humanized VHH) is also one embodiment of the single-domain antibody of the present invention. A "humanized single-domain antibody" refers to a chimeric single-domain antibody comprising amino acid residues from non-human CDRs and amino acid residues from human FRs. In certain embodiments, in a humanized single-domain antibody, all or substantially all CDRs correspond to those of a non-human antibody, and all or substantially all FRs correspond to those of a human antibody. In a humanized antibody, even when a portion of the residues in FR does not correspond to those of a human antibody, substantially all FRs are considered as an example corresponding to those of a human antibody. For example, when humanizing VHH which is an embodiment of the single-domain antibody, a portion of the residues in FR need to be residues not corresponding to those of a human antibody (C Vincke et al., The Journal of Biological Chemistry 284, 3273-3284).

Alternatively, the single-domain antibody can be obtained by ELISA, panning, or the like from a polypeptide library containing single-domain antibodies. Examples of the polypeptide library containing single-domain antibodies include, but are not limited to, naive antibody libraries obtained from various animals or humans (e.g., Methods in Molecular Biology 2012 911 (65-78); and Biochimica et Biophysica Acta—Proteins and Proteomics 2006 1764: 8 (1307-1319)), antibody libraries obtained by the immunization of various animals (e.g., Journal of Applied Microbiology 2014 117: 2 (528-536)), and synthetic antibody libraries prepared from antibody genes of various animals or humans (e.g., Journal of Biomolecular Screening 2016 21: 1 (35-43); Journal of Biological Chemistry 2016 291:24 (12641-12657); and AIDS 2016 30: 11 (1691-1701)).

In the present specification, the "antigen" is limited only by containing an epitope to which the antigen-binding domain binds. Preferred examples of the antigen include, but are not limited to, animal- or human-derived peptides, polypeptides, and proteins. Preferred examples of the antigen for use in the treatment of a disease caused by a target tissue include, but are not limited to, molecules expressed on the surface of target cells (e.g., cancer cells and inflammatory cells), molecules expressed on the surface of other cells in tissues containing target cells, molecules expressed on the surface of cells having an immunological role against target cells and tissues containing target cells, and macromolecules present in the stromata of tissues containing target cells.

Examples of the antigen can include the following molecules: 17-IA, 4-1BB, 4Dc, 6-keto-PGF1a, 8-iso-PGF2a, 8-oxo-dG, A1 adenosine receptor, A33, ACE, ACE-2, activin, activin A, activin AB, activin B, activin C, activin RIA, activin RIA ALK-2, activin RIB ALK-4, activin RIIA, activin RIIB, ADAM, ADAM10, ADAM12, ADAM15, ADAM17/TACE, ADAM8, ADAM9, ADAMTS, ADAMTS4, ADAMTS5, addressin, aFGF, ALCAM, ALK, ALK-1, ALK-7, alpha-1-antitrypsin, alpha-V/beta-1 antagonist, ANG, Ang, APAF-1, APE, APJ, APP, APRIL, AR, ARC, ART, artemin, anti-Id, ASPARTIC, atrial natriuretic factor, av/b3 integrin, Axl, b2M, B7-1, B7-2, B7-H, B-lymphocyte stimulator (BlyS), BACE, BACE-1, Bad, BAFF, BAFF-R, Bag-1, BAK, Bax, BCA-1, BCAM, Bcl, BCMA, BDNF, b-ECGF, bFGF, BID, Bik, BIM, BLC, BL-CAM, BLK, BMP, BMP-2 BMP-2a, BMP-3 osteogenin, BMP-4 BMP-2b, BMP-5, BMP-6 Vgr-1, BMP-7 (OP-1), BMP-8 (BMP-8a, OP-2), BMPR, BMPR-IA (ALK-3), BMPR-IB (ALK-6), BRK-2, RPK-1, BMPR-II (BRK-3), BMP, b-NGF, BOK, bombesin, bone-derived neurotrophic factor, BPDE, BPDE-DNA, BTC, complement factor 3 (C3), C3a, C4, C5, C5a, C10, CA125, CAD-8, calcitonin, cAMP, carcinoembryonic antigen (CEA), cancer-associated antigens, cathepsin A, cathepsin B, cathepsin C/DPPI, cathepsin D, cathepsin E, cathepsin H, cathepsin L, cathepsin O, cathepsin S, cathepsin V, cathepsin X/Z/P, CBL, CCI, CCK2, CCL, CCL1, CCL11, CCL12, CCL13, CCL14, CCL15, CCL16, CCL17, CCL18, CCL19, CCL2, CCL20, CCL21, CCL22, CCL23, CCL24, CCL25, CCL26, CCL27, CCL28, CCL3, CCL4, CCL5, CCL6, CCL7, CCL8, CCL9/10, CCR, CCR1, CCR10, CCR10, CCR2, CCR3, CCR4, CCR5, CCR6, CCR7, CCR8, CCR9, CD1, CD2, CD3, CD3E, CD4, CD5, CD6, CD7, CD8, CD10, CD11a, CD11b, CD11c, CD13, CD14, CD15, CD16, CD18, CD19, CD20, CD21, CD22, CD23, CD25, CD27L, CD28, CD29, CD30, CD30L, CD32, CD33 (p67 protein), CD34, CD38, CD40, CD40L, CD44, CD45, CD46, CD49a, CD52, CD54, CD55, CD56, CD61, CD64, CD66e, CD74, CD80 (B7-1), CD89, CD95, CD123, CD137, CD138, CD140a, CD146, CD147, CD148, CD152, CD164, CEACAM5, CFTR, cGMP, CINC, botulinum toxin, *Clostridium perfringens* toxin, CKb8-1, CLC, CMV, CMV UL, CNTF, CNTN-1, COX, C-Ret, CRG-2, CT-1, CTACK, CTGF, CTLA-4, PD-1, PD-L1, LAG3, TIM3, galectin-9, CX3CL1, CX3CR1, CXCL, CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CXCR, CXCR1, CXCR2, CXCR3, CXCR4, CXCR5, CXCR6, cytokeratin tumor-associated antigens, DAN, DCC, DcR3, DC-SIGN, decay accelerating factor, des(1-3)-IGF-I (brain IGF-1), Dhh, digoxin, DNAM-1, Dnase, Dpp, DPPIV/CD26, Dtk, ECAD, EDA, EDA-A1, EDA-A2, EDAR, EGF, EGFR (ErbB-1), EMA, EMMPRIN, ENA, endothelin receptor, enkephalinase, eNOS, Eot, eotaxin 1, EpCAM, ephrin B2/EphB4, ePO, ERCC, E-selectin, ET-1, factor IIa, factor VII, factor VIIIc, factor IX, fibroblast-activating protein (FAP), Fas, FcRI, FEN-1, ferritin, FGF, FGF-19, FGF-2, FGF3, FGF-8, FGFR, FGFR-3, fibrin, FL, FLIP, Flt-3, Flt-4, follicle-stimulating hormone, fractalkine, FZD1, FZD2, FZD3, FZD4, FZD5, FZD6, FZD7, FZD8, FZD9, FZD10, G250, Gas6, GCP-2, GCSF, GD2, GD3, GDF, GDF-1, GDF-3 (Vgr-2), GDF-5 (BMP-14, CDMP-1), GDF-6 (BMP-13, CDMP-2), GDF-7 (BMP-12, CDMP-3), GDF-8 (myostatin), GDF-9, GDF-15 (MIC-1), GDNF, GDNF, GFAP, GFRa-1, GFR-alpha 1, GFR-alpha 2, GFR-alpha 3, gITR, glucagon, Glut4, glycoprotein IIb/IIIa (GPIIb/IIIa), GM-CSF, gp130, gp72, GRO, growth hormone-releasing factor, hapten (NP-cap or NIP-cap), HB-EGF, HCC, HCMV gB envelope glycoprotein, HCMV gH envelope glycoprotein, HCMV UL, hematopoietic growth factor (HGF), Hep B gp120, heparanase, Her2, Her2/neu (ErbB-2), Her3 (ErbB-3), Her4 (ErbB-4), herpes simplex virus (HSV) gB glycoprotein, HSV gD glycoprotein, HGFA, high-molecular-weight melanoma-associated antigen (HMW-MAA), HIV gpl20, HIV IIIB gp120 V3 loop, HLA, HLA-DR, HM1.24, HMFG PEM, HRG, Hrk, human heart myosin, human cytomegalovirus (HCMV), human growth hormone (HGH), HVEM, I-309, IAP, ICAM, ICAM-1, ICAM-3, ICE, ICOS, IFNg, Ig, IgA receptor, IgE, IGF, IGF binding protein, IGF-1R, IGFBP, IGF-I, IGF-II, IL, IL-1, IL-1R, IL-2, IL-2R, IL-4, IL-4R, IL-5, IL-5R, IL-6, IL-6R, IL-8, IL-9, IL-10, IL-12, IL-13, IL-15, IL-18, IL-18R, IL-21, IL-23, IL-27, interferon (INF)-alpha, INF-beta, INF-gamma, inhibin, iNOS, insulin chain A, insulin chain B, insulin-like growth factor 1, integrin alpha 2, integrin alpha 3, integrin alpha 4, integrin alpha 4/beta 1, integrin alpha 4/beta 7, integrin alpha 5 (alpha V), integrin alpha 5/beta 1, integrin alpha 5/beta 3, integrin alpha 6, integrin beta 1, integrin beta 2, interferon gamma, IP-10, I-TAC, JE, kallikrein 2, kallikrein 5, kallikrein 6, kallikrein 11, kallikrein 12, kallikrein 14, kallikrein 15, kallikrein L1, kallikrein L2, kallikrein L3, kallikrein L4, KC, KDR, keratinocyte growth factor (KGF), laminin 5, LAMP, LAP, LAP (TGF-1), latent TGF-1, latent TGF-1 bpl, LBP, LDGF, LECT2, lefty, Lewis-Y antigen, Lewis-Y-related antigen, LFA-1, LFA-3, Lfo, LIF, LIGHT, lipoprotein, LIX, LKN, Lptn, L-selectin, LT-a, LT-b, LTB4, LTBP-1, lung surface, luteinizing hormone, lymphotoxin beta receptor, Mac-1, MAdCAM, MAG, MAP2, MARC, MCAM, MCAM, MCK-2, MCP, M-CSF, MDC, Mer, metalloproteinases, MGDF receptor, MGMT, MHC (HLA-DR), MIF, MIG, MIP, MIP-1-alpha, MK, MMAC1, MMP, MMP-1, MMP-10, MMP-11, MMP-12, MMP-13, MMP-14, MMP-15, MMP-2, MMP-24, MMP-3, MMP-7, MMP-8, MMP-9, MPIF, Mpo, MSK, MSP, mucin (Muc 1), MUC18, mullerian-inhibiting substance, Mug, MuSK, NAIP, NAP, NCAD, N-C adherin, NCA 90, NCAM, NCAM, neprilysin, neurotrophin-3, -4, or -6, neurturin, nerve growth factor (NGF), NGFR, NGF-beta, nNOS, NO, NOS, Npn, NRG-3, NT, NTN, OB, OGGI, OPG, OPN, OSM, OX40L, OX40R, p150, p95, PADPr, parathyroid hormone, PARC, PARP, PBR, PBSF, PCAD, P-cadherin, PCNA, PDGF, PDGF, PDK-1, PECAM, PEM, PF4, PGE, PGF, PGI2, PGJ2, PIN, PLA2, placental alkaline phosphatase (PLAP), PlGF, PLP, PP14, proinsulin, prorelaxin, protein C, PS, PSA, PSCA, prostate-specific membrane antigen (PSMA), PTEN, PTHrp, Ptk, PTN, R51, RANK, RANKL, RANTES, RANTES, relaxin A chain, relaxin B chain, renin, respiratory syncytial virus (RSV) F, RSV Fgp, Ret, rheumatoid factor, RLIP76, RPA2, RSK, S100, SCF/KL, SDF-1, SERINE, serum albumin, sFRP-3, Shh, SIGIRR, SK-1, SLAM, SLPI, SMAC, SMDF, SMOH, SOD, SPARC, Stat, STEAP, STEAP-II, TACE, TACI, TAG-72 (tumor-associated glycoprotein-72), TARC, TCA-3, T cell receptor (e.g., T cell receptor alpha/beta), TdT, TECK, TEM1, TEM5, TEM7, TEM8, TERT, testicular PLAP-like alkaline phosphatase, TfR, TGF, TGF-alpha, TGF-beta, TGF-beta Pan Specific, TGF-beta RI (ALK-5), TGF-beta RII, TGF-beta RIIb, TGF-beta RIII, TGF-beta 1, TGF-beta 2, TGF-beta 3, TGF-beta 4, TGF-beta 5, thrombin, thymus Ck-1, thyroid stimulating hormone, Tie, TIMP, TIQ, tissue factor, TMEFF2, Tmpo, TMPRSS2, TNF, TNF-alpha, TNF-alpha/beta, TNF-beta 2, TNFc, TNF-RI, TNF-RII, TNFRSF10A (TRAIL RI Apo-2, DR4), TNFRSF10B (TRAIL R2 DR5, KILLER, TRICK-2A, TRICK-B), TNFRSF10C (TRAIL R3 DcR1, LIT, TRID), TNFRSF10D (TRAIL R4 DcR2, TRUNDD), TNFRSF11A (RANK ODF R, TRANCE R), TNFRSF11B (OPG OCIF, TR1), TNFRSF12 (TWEAK R FN14), TNFRSF13B (TACI), TNFRSF13C (BAFF R), TNFRSF14 (HVEM ATAR, HveA, LIGHT R, TR2), TNFRSF16 (NGFR p75NTR), TNFRSF17 (BCMA), TNFRSF18 (GITR AITR), TNFRSF19 (TROY TAJ, TRADE), TNFRSF19L (RELT), TNFRSF1A (TNF RI CD120a, p55-60), TNFRSF1B (TNF RII CD120b, p75-80), TNFRSF26 (TNFRH3), TNFRSF3 (LTbR TNF RIII, TNFC R), TNFRSF4 (OX40 ACT35, TXGP1R), TNFRSF5 (CD40 p50), TNFRSF6 (Fas Apo-1, APT1, CD95), TNFRSF6B (DcR3 M68, TR6), TNFRSF7 (CD27), TNFRSF8 (CD30), TNFRSF9 (4-1BB CD137, ILA), TNFRSF21 (DR6), TNFRSF22 (DcTRAIL R2 TNFRH2), TNFRST23 (Dc-TRAIL RI TNFRH1), TNFRSF25 (DR3 Apo-3, LARD, TR-3, TRAMP, WSL-1), TNFSF10 (TRAIL Apo-2 ligand, TL2), TNFSF11 (TRANCE/RANK ligand ODF, OPG ligand), TNFSFl2 (TWEAK Apo-3 ligand, DR3 ligand), TNFSF13 (APRIL TALL2), TNFSF13B (BAFF BLYS, TALL1, THANK, TNFSF20), TNFSF14 (LIGHT HVEM ligand, LTg), TNFSF15 (TL1A/VEGI), TNFSF18 (GITR ligand AITR ligand, TL6), TNFSFIA (TNF-α Conectin, DIF, TNFSF2), TNFSFIB (TNF-b LTa, TNFSF1), TNFSF3 (LTb TNFC, p33), TNFSF4 (OX40 ligand gp34, TXGP1), TNFSF5 (CD40 ligand CD154, gp39, HIGMI, IMD3, TRAP), TNFSF6 (Fas ligand Apo-1 ligand, APT1 ligand), TNFSF7 (CD27 ligand CD70), TNFSF8 (CD30 ligand CD153), TNFSF9 (4-1BB ligand CD137 ligand), TP-1, t-PA, Tpo, TRAIL, TRAIL R, TRAIL-R1, TRAIL-R2, TRANCE, transferrin receptor, TRF, Trk, TROP-2, TLR (toll-like receptor) 1, TLR2, TLR3, TLR4, TLR5, TLR6, TLR7, TLR8, TLR9, TLR10, TSG, TSLP, tumor-associated antigen CA125, tumor-associated antigen-expressing Lewis-Y-related carbohydrate, TWEAK, TXB2, Ung, uPAR, uPAR-1, urokinase, VCAM, VCAM-1, VECAD, VE-cadherin, VE-cadherin-2, VEFGR-1 (flt-1), VEGF, VEGFR, VEGFR-3 (flt-4), VEGI, VIM, viral antigens, VLA, VLA-1, VLA-4, VNR integrin, von Willebrand factor, WIF-1, WNT1, WNT2, WNT2B/13, WNT3, WNT3A, WNT4, WNT5A, WNT5B, WNT6, WNT7A, WNT7B, WNT8A, WNT8B, WNT9A, WNT9A, WNT9B, WNT10A, WNT10B, WNT11, WNT16, XCL1, XCL2, XCR1, XCR1, XEDAR, XIAP, XPD, HMGB1, IgA, AR, CD81, CD97, CD98, DDR1, DKK1, EREG, Hsp90, IL-17/IL-17R, IL-20/IL-20R, oxidized LDL, PCSK9, prekallikrein, RON, TMEM16F, SOD1, chromogranin A, chromogranin B, tau, VAP1, high-molecular-weight kininogen, IL-31, IL-31R, Nav1.1, Nav1.2, Nav1.3, Nav1.4, Nav1.5, Nav1.6, Nav1.7, Nav1.8, Nav1.9, EPCR, C1, Clq, C1r, C1s, C2, C2a, C2b, C3, C3a, C3b, C4, C4a, C4b, C5, C5a, C5b, C6, C7, C8, C9, factor B, factor D, factor H, properdin, sclerostin, fibrinogen, fibrin, prothrombin, thrombin, tissue factor, factor V, factor Va, factor VII, factor VIIa, factor VIiI, factor VIIIa, factor IX, factor IXa, factor X, factor Xa, factor XI, factor XIa, factor XII, factor XIIa, factor XIII, factor XIIIa, TFPI, antithrombin III, EPCR, thrombomodulin, TAPI, tPA, plasminogen, plasmin, PAI-1, PAI-2, GPC3, syndecan-1, syndecan-2, syndecan-3, syndecan-4, LPA, SIP, and receptors for hormones or growth factors.

Although the examples of the antigen listed above also include receptors, these receptors even existing in a soluble form in a body fluid can be used as the antigen to which the antigen-binding domain of the present invention binds. One non-limiting example of the soluble form of such a receptor can include the protein represented by SEQ ID NO: 35 which is soluble IL-6R as described by Mullberg et al. (J. Immunol. (1994) 152 (10), 4958-4968).

The examples of the antigen listed above include membrane molecules expressed on cell membranes, and soluble molecules secreted from cells to the outside of the cells. When the antigen-binding domain of the present invention binds to a soluble molecule secreted from cells, the antigen-binding domain preferably has neutralizing activity.

The solution containing the soluble molecule is not limited, and this soluble molecule may exist in a body fluid, i.e., every vascular liquid or every liquid filling between tissues or cells in living bodies. In a non-limiting aspect, the soluble molecule to which the antigen-binding domain of the present invention binds can exist in an extracellular fluid. The extracellular fluid refers to a generic name for plasma, intercellular fluid, lymph, tight connective tissues, cerebrospinal fluid, spinal fluid, aspirates, synovial fluid, or such components in the bone and cartilage, alveolar fluid (bronchoalveolar lavage fluid), ascitic fluid, pleural effusion, cardiac effusion, cyst fluid, aqueous humor (hydatoid), or such transcellular fluids (various fluids in glandular cavities resulting from the active transport or secretory activity of cells, and fluids in the lumen of the gut and other body cavities) in vertebrates.

The epitope, which means an antigenic determinant, present in the antigen means a site on the antigen to which the antigen-binding domain disclosed in the present specification binds. Accordingly, for example, the epitope can be defined by its structure. Alternatively, the epitope may be defined by the antigen-binding activity of the antigen-binding domain recognizing the epitope. When the antigen is a peptide or a polypeptide, the epitope may be identified by amino acid residues constituting the epitope. When the epitope is a sugar chain, the epitope may be identified by a particular sugar chain structure.

A linear epitope refers to an epitope comprising an epitope that is recognized by its primary sequence of amino acids. The linear epitope contains typically at least 3 and most commonly at least 5, for example, approximately 8 to approximately 10 or 6 to 20 amino acids, in its unique sequence.

In contrast to the linear epitope, a conformational epitope refers to an epitope that is contained in a primary sequence of amino acids containing a component other than the single defined component of the epitope to be recognized (e.g., an epitope whose primary sequence of amino acids may not be recognized by an antibody that determines the epitope). The conformational epitope may contain an increased number of amino acids, as compared with the linear epitope. As for the recognition of the conformational epitope, the antigen-binding domain recognizes the three-dimensional structure of the peptide or the protein. For example, when a protein molecule is folded to form a three-dimensional structure, certain amino acids and/or polypeptide main chain constituting the conformational epitope are arranged in parallel to allow the antibody to recognize the epitope. Examples of the method for determining the conformation of the epitope include, but are not limited to, X-ray crystallography, two-dimensional nuclear magnetic resonance spectroscopy, and site-specific spin labeling and electron paramagnetic resonance spectroscopy. See, for example, Epitope Mapping Protocols in Methods in Molecular Biology (1996), Vol. 66, Morris ed.

The structure of the antigen-binding domain binding to the epitope is called paratope. The paratope stably binds to the epitope through a hydrogen bond, electrostatic force, van der Waals' forces, a hydrophobic bond, or the like acting between the epitope and the paratope. This binding force between the epitope and the paratope is called affinity. The total binding force when a plurality of antigen-binding domains bind to a plurality of antigens is called avidity. The affinity works synergistically when, for example, an antibody comprising a plurality of antigen-binding domains (i.e., a polyvalent antibody) bind to a plurality of epitopes. Therefore, the avidity is higher than the affinity.

In a particular embodiment, the antigen-binding domain provided in the present specification has a dissociation constant (Kd) of $\leq 1$ μM, $\leq 100$ nM, $\leq 10$ nM, $\leq 1$ nM, $\leq 0.1$ nM, $\leq 0.01$ nM or $\leq 0.001$ nM (e.g., $10^{-8}$ M or less, for example, $10^{-8}$ M to $10^{-13}$ M, for example, $10^{-9}$ M to $10^{-13}$ M).

Hereinafter, exemplary methods for confirming the binding of an antigen-binding domain directed to IL-6R, or a polypeptide comprising the antigen-binding domain to the epitope will be shown. However, a method for confirming the binding of an antigen-binding domain directed to an antigen other than IL-6R, or a polypeptide comprising the antigen-binding domain to the epitope can also be appropriately carried out according to the example given below.

For example, whether the antigen-binding domain directed to IL-6R recognizes a linear epitope present in the IL-6R molecule can be confirmed, for example, as follows: a linear peptide comprising an amino acid sequence constituting the extracellular domain of IL-6R is synthesized for the purpose described above. The peptide can be chemically synthesized. Alternatively, the peptide is obtained by a genetic engineering approach using a region encoding an amino acid sequence corresponding to the extracellular domain in IL-6R cDNA. Next, the antigen-binding domain directed to IL-6R is evaluated for its binding activity against the linear peptide comprising an amino acid sequence constituting the extracellular domain. For example, the binding activity of the antigen-binding domain against the peptide can be evaluated by ELISA using an immobilized linear peptide as an antigen. Alternatively, the binding activity against the linear peptide may be determined on the basis of a level at which the linear peptide inhibits the binding of the antigen-binding domain to IL-6R-expressing cells. These tests can determine the binding activity of the antigen-binding domain against the linear peptide.

Also, whether the antigen-binding domain directed to IL-6R recognizes the conformational epitope can be confirmed as follows: IL-6R-expressing cells are prepared for the purpose described above. The recognition of the conformational epitope by the antigen-binding domain directed to IL-6R is confirmed, for example, when the antigen-binding domain directed to IL-6R strongly binds to the IL-6R-expressing cells upon contact with the cells, whereas the antigen-binding domain does not substantially bind to an immobilized linear peptide comprising an amino acid sequence constituting the extracellular domain of IL-6R or a denatured (using a general denaturant such as guanidine) linear peptide comprising an amino acid sequence constituting the extracellular domain of IL-6R. In this context, the term "not substantially bind" means that the binding activity is 80% or less, usually 50% or less, preferably 30% or less, particularly preferably 15% or less of binding activity against cells expressing human IL-6R.

The methods for confirming the antigen-binding activity of the antigen-binding domain also include methods of measuring a Kd value by, for example, radiolabeled antigen binding assay (RIA). In one embodiment, RIA is carried out using the antigen-binding domain of interest and its antigen. For example, the binding affinity in a solution of the antigen-binding domain for the antigen is measured by equilibrating the antigen-binding domain with a minimal concentration of a (125I)-labeled antigen in the presence of a titration series of an unlabeled antigen, and subsequently capturing the bound antigen by a plate coated with the antigen-binding domain (see e.g., Chen et al., J. Mol. Biol. 293: 865-881(1999)).

According to an alternative embodiment, Kd is measured by a surface plasmon resonance method using BIACORE (registered trademark). For example, assay using BIACORE (registered trademark)-2000 or BIACORE (registered trademark)-3000 (BIAcore, Inc., Piscataway, NJ) is carried out at 25° C. using a CM5 chip with approximately 10 response units (RU) of the antigen immobilized thereon. In one embodiment, a carboxymethylated dextran biosensor chip (CM5, BIAcore, Inc.) is activated using N-ethyl-N'-(3-dimethylaminopropyl)-carbodiimide hydrochloride (EDC) and N-hydroxysuccinimide (NHS) according to the supplier's instruction. The antigen is diluted to 5 μg/ml (approximately 0.2 μM) with 10 mM sodium acetate (pH 4.8) and then injected thereto at a flow rate of 5 μl/min so as to attain protein binding at approximately 10 response units (RU). After the antigen injection, 1 M ethanolamine is injected thereto in order to block unreacted groups. For kinetic measurement, 2-fold dilutions (0.78 nM to 500 nM) of the antigen-binding domain in PBS containing 0.05% Polysorbate 20 (TWEEN-20 (trademark)) as a surfactant (PBST) are injected thereto at a flow rate of approximately 25 μl/min at 25° C. An association rate (kon) and a dissociation rate (koff) are calculated by fitting sensorgrams of association and dissociation at the same time using a simple 1:1 Langmuir binding model (BIACORE (registered trademark) evaluation software version 3.2). An equilibrium dissociation constant (Kd) is calculated as a koff/kon ratio. Furthermore, an apparent dissociation constant (Kd) may be determined by use of equilibrium analysis. For these procedures, see the protocol attached to BIACORE (registered trademark). See, for example, Chen et al., J. Mol. Biol. 293: 865-881 (1999) and Methods Enzymol. 2000; 323: 325-40. In the surface plasmon resonance assay, the amount of the protein immobilized, the amount of the protein used in reaction, temperature, and solution composition can be variously changed by those skilled in the art. When the on-rate in the surface plasmon resonance assay described above exceeds 106 M-1s-1, the on-rate can be determined by use of a fluorescence quenching technique of using a spectrometer (e.g. a stopped-flow spectrophotometer (Aviv Instruments, Inc.) or SLM-AMINCO (trademark) spectrophotometer 8000 series (Thermo Spectronic/Thermo Fisher Scientific Inc.) using a stirring cuvette) to measure increase or decrease in fluorescence intensity (excitation=295 nm; emission=340 nm, band path: 16 nm) at 25° C. for 20 nM antigen-binding domain in PBS (pH 7.2) in the presence of gradually increased concentrations of the antigen.

Furthermore, the antigen-binding activity of the antigen-binding domain can also be measured by a known molecule-molecule interaction measurement method such as electrogenerated chemiluminescence.

Examples of the method for measuring the binding activity of the antigen-binding domain directed to IL-6R against the II-6R-expressing cells include methods described in Antibodies: A Laboratory Manual (Ed Harlow, David Lane, Cold Spring Harbor Laboratory (1988) 359-420). Specifically, the binding activity can be evaluated on the basis of the principle of ELISA or FACS (fluorescence activated cell sorting) using the IL-6R-expressing cells as an antigen.

In the ELISA format, the binding activity of the antigen-binding domain directed to IL-6R against the IL-6R-expressing cells is quantitatively evaluated by comparing the levels of signals generated through enzymatic reaction. Specifically, a test antigen-binding domain is added to an ELISA plate with the IL-6R-expressing cells immobilized thereon. Then, the test antigen-binding domain bound with the cells is detected through the use of an enzyme-labeled antibody recognizing the test antigen-binding domain. Alternatively, in the FACS, a dilution series of a test antigen-binding domain is prepared, and the antibody binding titer for the IL-6R-expressing cells can be determined to compare the binding activity of the test antigen-binding domain against the IL-6R-expressing cells.

The binding of the test antigen-binding domain to the antigen expressed on the surface of cells suspended in a buffer solution or the like can be detected using a flow cytometer. For example, the following apparatuses are known as the flow cytometer:

FACSCanto™ II
FACSAria™
FACSArray™
FACSVantage™ SE
FACSCalibur™ (all are trade names of BD Biosciences)
EPICS ALTRA HyPerSort
Cytomics FC 500
EPICS XL-MCL ADC EPICS XL ADC
Cell Lab Quanta/Cell Lab Quanta SC (all are trade names of Beckman Coulter, Inc.)

One preferred example of the method for measuring the antigen-binding activity of the antigen-binding domain directed to IL-6R includes the following method: first, IL-6R-expressing cells reacted with a test antigen-binding domain are stained with a FITC-labeled secondary antibody recognizing the test antigen-binding domain. The test antigen-binding domain is appropriately diluted with a suitable buffer solution to prepare the antigen-binding domain at the desired concentration for use. The antigen-binding domain can be used, for example, at any concentration from 10 μg/ml to 10 ng/ml. Next, fluorescence intensity and the number of cells are measured using FACSCalibur (Becton, Dickinson and Company). The amount of the antigen-binding domain bound to the cells is reflected in the fluorescence intensity obtained by analysis using CELL QUEST Software (Becton, Dickinson and Company), i.e., a geometric mean value. In short, the binding activity of the test antigen-binding domain indicated by the amount of the test antigen-binding domain bound can be determined by obtaining the geometric mean value.

Whether the antigen-binding domain directed to IL-6R shares an epitope with a certain antigen-binding domain can be confirmed by the competition between these antigen-binding domains for the same epitope. The competition between the antigen-binding domains is detected by cross-blocking assay or the like. The cross-blocking assay is preferably, for example, competitive ELISA assay.

Specifically, in the cross-blocking assay, IL-6R protein-coated wells of a microtiter plate are preincubated in the presence or absence of a candidate competitive antigen-binding domain. Then, a test antigen-binding domain is added thereto. The amount of the test antigen-binding domain bound with the IL-6R protein in the wells indirectly correlates with the binding capacity of the candidate competitive antigen-binding domain that competes for the binding to the same epitope. In short, larger affinity of the competitive antigen-binding domain for the same epitope means lower binding activity of the test antigen-binding domain against the IL-6R protein-coated wells.

The amount of the test antigen-binding domain bound with the wells via the IL-6R protein can be easily measured by labeling the antigen-binding domain in advance. For example, a biotin-labeled antigen-binding domain is assayed by using an avidin-peroxidase conjugate and an appropriate substrate. In particular, cross-blocking assay that utilizes enzyme labels such as peroxidase is called competitive ELISA assay. The antigen-binding domain can be labeled with an alternative detectable or measurable labeling material. Specifically, radiolabels, fluorescent labels, and the like are known in the art.

Provided that the competitive antigen-binding domain can block the binding of the antigen-binding domain directed to IL-6R by at least 20%, preferably at least 20 to 50%, more preferably at least 50% as compared with binding activity obtained in a control test carried out in the absence of the candidate competitive antigen-binding domain, the test antigen-binding domain is determined as an antigen-binding domain substantially binding to the same epitope as that for the competitive antigen-binding domain, or competing for the binding to the same epitope.

When the epitope to which the antigen-binding domain directed to IL-6R binds has an identified structure, whether a test antigen-binding domain and a control antigen-binding domain share an epitope can be evaluated by comparing the binding activity of these antigen-binding domains against a peptide or a polypeptide prepared by introducing an amino acid mutation to a peptide constituting the epitope.

In such a method for measuring binding activity, for example, the binding activity of a test antigen-binding domain and a control antigen-binding domain against a linear peptide containing an introduced mutation can be compared in the ELISA format described above. In a method other than ELISA, the binding activity against the mutant peptide bound with a column may be measured by flowing the test antigen-binding domain and the control antigen-binding domain in the column, and then quantifying the antigen-binding domain eluted in the eluate. A method for adsorbing a mutant peptide, for example, as a fusion peptide with GST, to a column is known in the art.

When the identified epitope is a conformational epitope, whether a test antigen-binding domain and a control antigen-binding domain share an epitope can be evaluated by the following method: first, IL-6R-expressing cells and cells expressing IL-6R with a mutation introduced to the epitope are prepared. The test antigen-binding domain and the control antigen-binding domain are added to cell suspensions containing these cells suspended in an appropriate buffer solution such as PBS. Subsequently, the cell suspensions are appropriately washed with a buffer solution, and a FITC-labeled antibody capable of recognizing the test antigen-binding domain and the control antigen-binding domain is then added thereto. The fluorescence intensity and the number of cells stained with the labeled antibody are measured using FACSCalibur (Becton, Dickinson and Company). The test antigen-binding domain and the control antigen-binding domain are appropriately diluted with a suitable buffer solution and used at concentrations thereby adjusted to the desired ones. These antigen-binding domains are used, for example, at any concentration from 10 μg/ml to 10 ng/ml. The amount of the labeled antibody bound to the cells is reflected in the fluorescence intensity obtained by analysis using CELL QUEST Software (Becton, Dickinson and Company), i.e., a geometric mean value. In short, the binding activity of the test antigen-binding domain and the control antigen-binding domain indicated by the amount of the labeled antibody bound can be determined by obtaining the geometric mean value.

The competition of the antigen-binding domain with another antigen-binding domain for the same epitope can also be confirmed by use of radiolabeled antigen binding assay (RIA), BIACORE (registered trademark) surface plasmon resonance assay, electrogenerated chemiluminescence, or the like, in addition to ELISA or FACS described above.

In the present method, whether to "not substantially bind to cells expressing mutant IL-6R" can be determined, for example, by the following method: first, a test antigen-binding domain and a control antigen-binding domain bound with the cells expressing mutant IL-6R are stained with a labeled antibody. Subsequently, the fluorescence intensity of the cells is detected. In the case of using FACSCalibur in the fluorescence detection by flow cytometry, the obtained fluorescence intensity can be analyzed using the CELL QUEST Software. From geometric mean values obtained in the presence and absence of the polypeptide association product, their comparison value (ΔGeo-Mean) can be calculated according to expression 1 given below to determine the rate of increase in fluorescence intensity caused by the binding of the antigen-binding domain.

ΔGeo-Mean=Geo-Mean (in the presence of the polypeptide association product)/Geo-Mean (in the absence of the polypeptide association product) (Expression 1)

The geometric mean comparison value (ΔGeo-Mean value for the mutant IL-6R molecule) thus obtained by analysis, which reflects the amount of the test antigen-binding domain bound with the cells expressing mutant IL-6R, is compared with the ΔGeo-Mean comparison value that reflects the amount of the test antigen-binding domain bound to the IL-6R-expressing cells. In this case, the concentrations of the test antigen-binding domain used for determining the ΔGeo-Mean comparison values for the cells expressing mutant IL-6R and the IL-6R-expressing cells are particularly preferably adjusted to equal or substantially equal concentrations. An antigen-binding domain already confirmed to recognize an epitope in IL-6R is used as the control antigen-binding domain.

Provided that the ΔGeo-Mean comparison value of the test antigen-binding domain for the cells expressing mutant IL-6R is smaller than at least 80%, preferably 50%, more preferably 30%, particularly preferably 15% of the ΔGeo-Mean comparison value of the test antigen-binding domain for the IL-6R-expressing cells, the test antigen-binding domain "does not substantially bind to cells expressing mutant IL-6R". The calculation expression for determining the Geo-Mean (geometric mean) value is described in the CELL QUEST Software User's Guide (BD biosciences). The epitope for the test antigen-binding domain and that for the control antigen-binding domain can be assessed as being the same when their comparison values can be regarded as being substantially equivalent as a result of comparison.

In the present specification, the term "carrying moiety" refers to a moiety other than an antigen-binding domain in a polypeptide. The carrying moiety of the present invention is usually a peptide or a polypeptide constituted by amino acids. In a specific embodiment, the carrying moiety in the polypeptide is linked to the antigen-binding domain via a cleavage site. The carrying moiety of the present invention may be a series of peptides or polypeptides connected through an amide bond(s), or may be a complex formed from a plurality of peptides or polypeptides through a covalent bond(s) such as a disulfide bond or a noncovalent bond such as a hydrogen bond or hydrophobic interaction.

The carrying moiety of the present invention has an inhibiting domain that inhibits the antigen-binding activity of the antigen-binding domain. In the present specification, the term "inhibiting domain" is limited only by the inhibition the antigen-binding activity of the antigen-binding domain. The inhibiting domain can be a domain having any structure as long as the domain used can inhibit the antigen-binding activity of the antigen-binding domain. Examples of such an inhibiting domain include, but are not limited to, antibody heavy chain variable regions (VH), antibody light chain variable regions (VL), pre-B cell receptors, and single-domain antibodies. The inhibiting domain may constitute the whole of the carrying moiety or may constitute a portion of the carrying moiety.

In some embodiments of the present invention, the antigen-binding domain released from the polypeptide has higher antigen-binding activity than that before the release. In other words, the antigen-binding activity of the antigen-binding domain is inhibited by the inhibiting domain in a state where the antigen-binding domain is unreleased from the polypeptide. Whether the antigen-binding activity of the antigen-binding domain is inhibited by the inhibiting domain is confirmed by a method such as FACS (fluorescence activated cell sorting), ELISA (enzyme-linked immunosorbent assay), ECL (electrogenerated chemiluminescence), a SPR (surface plasmon resonance) method (Biacore), BLI (biolayer interferometry) (Octet). In some embodiments of the present invention, the antigen-binding activity of the antigen-binding domain released from the polypeptide is a value equal to or greater than twice, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, 2000 times, or 3000 times the binding activity of the antigen-binding domain unreleased from the polypeptide. In some more specific embodiments of the present invention, the binding of the antigen-binding domain before the release to the antigen is not seen when the antigen-binding activity of the antigen-binding domain is measured by one method selected from among the methods described above.

In some aspects of the present invention, the cleavage site is cleaved so that the antigen-binding domain becomes capable of being released from the polypeptide. In such aspects, therefore, the antigen-binding activity can be compared between before and after the cleavage of the polypeptide. Specifically, the antigen-binding activity measured using the cleaved polypeptide is a value equal to or greater than twice, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, 2000 times, or 3000 times the antigen-binding activity measured using the uncleaved polypeptide. In some more specific embodiments, the binding of the antigen-binding domain of the uncleaved polypeptide to the antigen is not seen when the antigen-binding activity is measured by one method selected from among the methods described above.

In some aspects of the present invention, the cleavage site is cleaved by protease. In such aspects, therefore, the antigen-binding activity can be compared between before and after the protease treatment of the polypeptide. Specifically, the antigen-binding activity measured using the polypeptide after the protease treatment is a value equal to or greater than twice, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, 2000 times, or 3000 times the antigen-binding activity measured using the polypeptide without the protease treatment. In some more specific embodiments, the binding of the antigen-binding domain of the protease-untreated polypeptide to the antigen is not seen when the antigen-binding activity is measured by one method selected from among the methods described above.

In the present invention, the polypeptide comprising an antigen-binding domain and a carrying moiety has a longer half-life in blood than that of the antigen-binding domain existing alone. In some embodiments of the present invention, for the longer half-life of the polypeptide, the carrying moiety is designed so as to have a longer half-life in blood. In such embodiments, examples of the approach of extending the half-life in blood of the carrying moiety include, but are not limited to, a large molecular weight of the carrying moiety, FcRn-binding activity possessed by the carrying moiety, albumin-binding activity possessed by the carrying moiety, and the PEGylation of the carrying moiety. In some embodiments of the present invention, the carrying moiety has a longer half-life in blood than that of the antigen-binding domain (in other words, the antigen-binding domain has a shorter half-life in blood than that of the carrying moiety).

In the present invention, the half-lives of the antigen-binding domain alone and the polypeptide, or the half-lives in blood of the antigen-binding domain and the carrying moiety are preferably compared in terms of their half-lives in blood in humans. If the half-lives in blood are difficult to measure in humans, the half-lives in blood in humans can be predicted on the basis of their half-lives in blood in mice (e.g., normal mice, transgenic mice expressing a human antigen, and transgenic mice expressing human FcRn) or monkeys (e.g., cynomolgus monkeys).

In one embodiment, the approach of extending the half-life in blood of the carrying moiety includes a large molecular weight of the carrying moiety. In one embodiment, the approach of rendering the half-life in blood of the carrying moiety longer than that of the antigen-binding domain includes making the molecular weight of the carrying moiety be higher than that of the antigen-binding domain.

In one embodiment, the approach of extending the half-life in blood of the carrying moiety includes conferring FcRn-binding activity to the carrying moiety. The carrying moiety can usually possess FcRn-binding activity by a method of establishing a FcRn-binding region in the carrying moiety. The FcRn-binding region refers to a region having binding activity against FcRn and may have any structure as long as the region used has binding activity against FcRn.

The carrying moiety containing a FcRn-binding region is capable of being taken up into cells and then brought back into plasma through the salvage pathway of FcRn. For example, an IgG molecule has a relatively long circulation time in plasma (slow disappearance) because FcRn known as a salvage receptor of the IgG molecule functions. An IgG molecule taken up into the endosome through pinocytosis binds to FcRn expressed in the endosome under intraendosomal acidic conditions. An IgG molecule that has failed to bind to FcRn is moved to the lysosome and degraded therein, whereas the IgG molecule bound with FcRn is transferred to cell surface, then dissociated from the FcRn under neutral conditions in plasma, and thereby brought back into plasma.

The FcRn-binding region is preferably a region binding directly to FcRn. Preferred examples of the FcRn-binding region can include antibody Fc regions. However, a region capable of binding to a polypeptide, such as albumin or IgG, which has FcRn-binding ability is capable of binding indirectly to FcRn via albumin, IgG, or the like. Therefore, the FcRn-binding region according to the present invention may be a region binding to such a polypeptide having FcRn-binding ability.

The binding activity of the FcRn-binding region according to the present invention against FcRn, particularly, human FcRn may be measured by a method known to those skilled in the art, as mentioned in the above section about binding activity. The conditions therefor may be appropriately determined by those skilled in the art. The binding activity against human FcRn can be evaluated as KD (dissociation constant), apparent KD (apparent dissociation constant), kd (dissociation rate), or apparent kd (apparent dissociation rate), etc. These values can be measured by methods known to those skilled in the art. For example, Biacore (GE Healthcare Japan Corp.), Scatchard plot, flow cytometers, and the like can be used.

The conditions for measuring the binding activity of the FcRn-binding region against FcRn are not particularly limited and may be appropriately selected by those skilled in the art. The binding activity can be measured under conditions involving, for example, a MES buffer and at 37° C., as described in WO2009/125825. Also, the binding activity of the FcRn-binding region of the present invention against FcRn may be measured by a method known to those skilled in the art and can be measured using, for example, Biacore (GE Healthcare Japan Corp.). In the measurement of the binding activity of the FcRn-binding region against FcRn, FcRn and the FcRn-binding region or the carrying moiety containing the FcRn-binding region can be injected as analytes to chips onto which the FcRn-binding region or the carrying moiety containing the FcRn-binding region and FcRn, respectively, are immobilized, followed by evaluation.

As for pH for use in the measurement conditions, the binding affinity of the FcRn-binding region for FcRn may be evaluated at any pH of 4.0 to 6.5. Preferably, a pH of 5.8 to 6.0, which is close to pH in the early endosome in vivo, is used for determining the binding affinity of the FcRn-binding region for human FcRn. As for temperature for use in the measurement conditions, the binding affinity of the FcRn-binding region for FcRn may be evaluated at any temperature of 10° C. to 50° C. Preferably, a temperature of 15° C. to 40° C. is used for determining the binding affinity of the FcRn-binding region for human FcRn. More preferably, any temperature from 20° C. to 35° C., for example, any one of 20, 21, 22, 23, 24, 25, 26, 27, 28, 29, 30, 31, 32, 33, 34, and 35° C., is also used for determining the binding affinity of the FcRn-binding region for FcRn. The temperature of 25° C. is one non-limiting example of the embodiments of the present invention.

One example of the FcRn-binding region includes, but is not limited to, an IgG antibody Fc region. In the case of using an IgG antibody Fc region, its type is not limited, and for example, IgG1, IgG2, IgG3, or IgG4 Fc region may be used. For example, an Fc region containing one sequence selected from the amino acid sequences represented by SEQ ID NOs: 21, 22, 23, and 24 may be used.

A native IgG antibody Fc region as well as an Fc region variant having one or more amino acid substitutions may be used as long as the Fc region has FcRn-binding activity. For example, an Fc region variant containing an amino acid sequence derived from an IgG antibody Fc region by the substitution of at least one amino acid selected from EU numbering positions 237, 238, 239, 248, 250, 252, 254, 255, 256, 257, 258, 265, 270, 286, 289, 297, 298, 303, 305, 307, 308, 309, 311, 312, 314, 315, 317, 325, 332, 334, 360, 376, 380, 382, 384, 385, 386, 387, 389, 424, 428, 433, 434 and 436 with another amino acid may be used.

More specifically, an Fc region variant containing at least one amino acid substitution selected from an amino acid substitution to substitute Gly at position 237 with Met,
an amino acid substitution to substitute Pro at position 238 with Ala,
an amino acid substitution to substitute Ser at position 239 with Lys,
an amino acid substitution to substitute Lys at position 248 with Ile,
an amino acid substitution to substitute Thr at position 250 with Ala, Phe, Ile, Met, Gln, Ser, Val, Trp, or Tyr,
an amino acid substitution to substitute Met at position 252 with Phe, Trp, or Tyr,
an amino acid substitution to substitute Ser at position 254 with Thr,
an amino acid substitution to substitute Arg at position 255 with Glu,
an amino acid substitution to substitute Thr at position 256 with Asp, Glu, or Gln,
an amino acid substitution to substitute Pro at position 257 with Ala, Gly, Ile, Leu, Met, Asn, Ser, Thr, or Val,
an amino acid substitution to substitute Glu at position 258 with His,
an amino acid substitution to substitute Asp at position 265 with Ala,
an amino acid substitution to substitute Asp at position 270 with Phe,
an amino acid substitution to substitute Asn at position 286 with Ala or Glu,
an amino acid substitution to substitute Thr at position 289 with His,
an amino acid substitution to substitute Asn at position 297 with Ala,
an amino acid substitution to substitute Ser at position 298 with Gly,
an amino acid substitution to substitute Val at position 303 with Ala,
an amino acid substitution to substitute Val at position 305 with Ala,
an amino acid substitution to substitute Thr at position 307 with Ala, Asp, Phe, Gly, His, Ile, Lys, Leu, Met, Asn, Pro, Gln, Arg, Ser, Val, Trp, or Tyr,
an amino acid substitution to substitute Val at position 308 with Ala, Phe, Ile, Leu, Met, Pro, Gln, or Thr,
an amino acid substitution to substitute Leu or Val at position 309 with Ala, Asp, Glu, Pro, or Arg,
an amino acid substitution to substitute Gln at position 311 with Ala, His, or Ile,
an amino acid substitution to substitute Asp at position 312 with Ala or His,
an amino acid substitution to substitute Leu at position 314 with Lys or Arg,
an amino acid substitution to substitute Asn at position 315 with Ala or His,
an amino acid substitution to substitute Lys at position 317 with Ala,
an amino acid substitution to substitute Asn at position 325 with Gly,
an amino acid substitution to substitute Ile at position 332 with Val,
an amino acid substitution to substitute Lys at position 334 with Leu,
an amino acid substitution to substitute Lys at position 360 with His,
an amino acid substitution to substitute Asp at position 376 with Ala,
an amino acid substitution to substitute Glu at position 380 with Ala,
an amino acid substitution to substitute Glu at position 382 with Ala,
an amino acid substitution to substitute Asn or Ser at position 384 with Ala,
an amino acid substitution to substitute Gly at position 385 with Asp or His,
an amino acid substitution to substitute Gln at position 386 with Pro,
an amino acid substitution to substitute Pro at position 387 with Glu,
an amino acid substitution to substitute Asn at position 389 with Ala or Ser,
an amino acid substitution to substitute Ser at position 424 with Ala,
an amino acid substitution to substitute Met at position 428 with Ala, Asp, Phe, Gly, His, Ile, Lys, Leu, Asn, Pro, Gln, Ser, Thr, Val, Trp, or Tyr,
an amino acid substitution to substitute His at position 433 with Lys,
an amino acid substitution to substitute Asn at position 434 with Ala, Phe, His, Ser, Trp, or Tyr, and
an amino acid substitution to substitute Tyr or Phe at position 436 with His (all according to the EU numbering)

in an IgG antibody Fc region may be used.

From another viewpoint, an Fc region containing at least one amino acid selected from Met as the amino acid at position 237,
Ala as the amino acid at position 238,
Lys as the amino acid at position 239,
Ile as the amino acid at position 248,
Ala, Phe, Ile, Met, Gln, Ser, Val, Trp, or Tyr as the amino acid at position 250,
Phe, Trp, or Tyr as the amino acid at position 252,
Thr as the amino acid at position 254,
Glu as the amino acid at position 255,
Asp, Glu, or Gln as the amino acid at position 256,
Ala, Gly, Ile, Leu, Met, Asn, Ser, Thr, or Val as the amino acid at position 257,
His as the amino acid at position 258,
Ala as the amino acid at position 265,
Phe as the amino acid at position 270,
Ala or Glu as the amino acid at position 286, His as the amino acid at position 289,
Ala as the amino acid at position 297,
Gly as the amino acid at position 298,
Ala as the amino acid at position 303,
Ala as the amino acid at position 305,
Ala, Asp, Phe, Gly, His, Ile, Lys, Leu, Met, Asn, Pro, Gln, Arg, Ser, Val, Trp, or Tyr as the amino acid at position 307,
Ala, Phe, Ile, Leu, Met, Pro, Gln, or Thr as the amino acid at position 308,
Ala, Asp, Glu, Pro, or Arg as the amino acid at position 309,
Ala, His, or Ile as the amino acid at position 311,
Ala or His as the amino acid at position 312,
Lys or Arg as the amino acid at position 314,
Ala or His as the amino acid at position 315,
Ala as the amino acid at position 317,
Gly as the amino acid at position 325,
Val as the amino acid at position 332,
Leu as the amino acid at position 334,
His as the amino acid at position 360,
Ala as the amino acid at position 376,
Ala as the amino acid at position 380,
Ala as the amino acid at position 382,
Ala as the amino acid at position 384,
Asp or His as the amino acid at position 385,
Pro as the amino acid at position 386,
Glu as the amino acid at position 387,
Ala or Ser as the amino acid at position 389,
Ala as the amino acid at position 424,
Ala, Asp, Phe, Gly, His, Ile, Lys, Leu, Asn, Pro, Gln, Ser, Thr, Val, Trp, or Tyr as the amino acid at position 428,
Lys as the amino acid at position 433,
Ala, Phe, His, Ser, Trp, or Tyr as the amino acid at position 434, and
His as the amino acid at position 436
(all according to the EU numbering) in an IgG antibody Fc region may be used.

The FcRn-binding activity possessed by the carrying moiety does not mean that the antigen-binding domain has no FcRn-binding activity. In the embodiments in which the carrying moiety has a longer half-life in blood than that of the antigen-binding domain, the antigen-binding domain may have no FcRn-binding activity, as a matter of course, or the antigen-binding domain may have FcRn-binding activity as long as the FcRn-binding activity is weaker than that of the carrying moiety.

In one embodiment, the method for extending the half-life in blood of the carrying moiety involves binding the carrying moiety to albumin. Since albumin does not undergo renal excretion and has FcRn-binding ability, its half-life in blood is as long as 17 days to 19 days (J Clin Invest. 1953 August; 32 (8): 746-768). Hence, it has been reported that a protein bound to albumin becomes bulky and capable of binding indirectly to FcRn and therefore has an increased half-life in blood (Antibodies 2015, 4 (3), 141-156).

In one embodiment, the alternative method for extending the half-life in blood of the carrying moiety involves PEGylating the carrying moiety. The PEGylation of a protein is considered to render the protein bulky and also suppress its degradation by protease in blood, thereby extending the half-life in blood of the protein (J Pharm Sci. 2008 October; 97 (10): 4167-83).

In some embodiments of the present invention, the carrying moiety contains an antibody Fc region. In a specific embodiment, the carrying moiety contains a CH2 domain and a CH3 domain of a human IgG antibody. In a specific embodiment, the carrying moiety contains a moiety extending from human IgG1 antibody heavy chain Cys226 or Pro230 to the carboxyl-terminus of the heavy chain. However, the C-terminal lysine (Lys447) or glycine-lysine (Gly446-Lys447) of the Fc region may or may not be present.

In some embodiments of the present invention, the carrying moiety contains an antibody constant region. In a more preferred embodiment, the carrying moiety contains an IgG antibody constant region. In a further preferred embodiment, the carrying moiety contains a human IgG antibody constant region.

In some embodiments of the present invention, the carrying moiety contains: a region substantially similar in structure to an antibody heavy chain constant region; and a region substantially similar in structure to an antibody light chain, connected to the region via a covalent bond such as a disulfide bond or a noncovalent bond such as a hydrogen bond or hydrophobic interaction.

In the present specification, the "polypeptide comprising an antigen-binding domain and a carrying moiety" is usually a series of polypeptides connected through an amide bond(s), or a protein containing a plurality of polypeptides connected through an amide bond(s).

In some embodiments of the present invention, the antigen-binding domain is capable of being released from the polypeptide, and the antigen-binding domain released from the polypeptide has higher antigen-binding activity. In the present specification, the term "release" refers to the mutual separation of two moieties of the polypeptide. The release of the antigen-binding domain from the polypeptide can be attributed to the cancelation of the interaction between the antigen-binding domain and the carrying moiety. The antigen-binding activity of the antigen-binding domain incorporated into the polypeptide is inhibited. Hence, the antigen-binding domain released from the polypeptide can be confirmed by measuring the antigen-binding activity of a subject and comparing it with the antigen-binding activity of the antigen-binding domain incorporated into the polypeptide.

In some embodiments, the polypeptide comprises a cleavage site, and the cleavage site is cleaved so that the antigen-binding domain is released from the polypeptide. The cleavage site can be cleaved by, for example, an enzyme, can be reduced with a reducing agent, or can be photodegraded. The cleavage site may be placed at any position in the polypeptide as long as the antigen-binding domain can be released and does not lose its antigen-binding activity after the release. The polypeptide may further contain an additional cleavage site other than the cleavage site for the release of the antigen-binding domain. In one embodiment of the present invention, the cleavage site comprises a protease cleavage sequence and can be cleaved by a protease(s).

In the present specification, the term "cleaved" refers to a state where the antigen-binding domain and the carrying moiety are separated from each other after alteration of the cleavage site by protease, reduction of a cysteine-cysteine disulfide bond at the cleavage site, and/or photoactivation. In the present specification, the term "uncleaved" refers to a state where the antigen-binding domain is linked to the carrying moiety in the absence of the protease cleavage of the cleavage site, in the absence of the reduction of a cysteine-cysteine disulfide bond at the cleavage site, and/or in the absence of light.

The cleavage of the cleavage site can be detected by subjecting a solution containing the cleavage site-containing polypeptide to SDS-PAGE (polyacrylamide gel electrophoresis) and measuring the molecular weights of the fragments or detecting change in molecular weight between before and after the cleavage.

The cleavage site can be specifically modified (cleaved, reduced or photodegraded) by an agent (i.e., protease, a reducing agent, or light) at a rate of approximately 0.001 to 1500×10⁴ M-1S-1 or at least 0.001, 0.005, 0.01, 0.05, 0.1, 0.5, 1, 2.5, 5, 7.5, 10, 15, 20, 25, 50, 75, 100, 125, 150, 200, 250, 500, 750, 1000, 1250, or 1500×10⁴ M-1S-1.

The specific cleavage by protease is performed by the contact between the protease and the cleavage site or a molecule containing the cleavage site. The cleavage site can be cleaved in the presence of sufficient enzyme activity. The sufficient enzyme activity can refer to the ability of the enzyme to bring about cleavage upon contact with the cleavage site.

In the present specification, the term "protease" refers to an enzyme such as endopeptidase or exopeptidase which hydrolyzes a peptide bond, typically, endopeptidase. The protease used in the present invention is limited only by being capable of cleaving the protease cleavage sequence and is not particularly limited by its type. In some embodiments, target tissue specific protease is used. The target tissue specific protease can refer to, for example, any of
(1) protease that is expressed at a higher level in the target tissue than in a normal tissue,
(2) protease that has higher activity in the target tissue than in a normal tissue,
(3) protease that is expressed at a higher level in the target cells than in a normal cell, and
(4) protease that has higher activity in the target cells than in a normal cell.

In a more specific embodiment, a cancer tissue specific protease or an inflammatory tissue specific protease is used.

In the present specification, the term "target tissue" means a tissue containing at least one target cell. In some embodiments of the present invention, the target tissue is a cancer tissue. In some embodiments of the present invention, the target tissue is an inflammatory tissue.

The term "cancer tissue" means a tissue containing at least one cancer cell. Thus, considering that, for example, the cancer tissue contains cancer cells and vascular vessels, every cell type that contributes to the formation of tumor mass containing cancer cells and endothelial cells is included in the scope of the present invention. In the present specification, the tumor mass refers to a foci of tumor tissue. The term "tumor" is generally used to mean benign neoplasm or malignant neoplasm.

In the present specification, examples of the "inflammatory tissue" include the following:
a joint tissue in rheumatoid arthritis or osteoarthritis,
a lung (alveolus) in bronchial asthma or COPD,
a digestive organ tissue in inflammatory bowel disease, Crohn disease, or ulcerative colitis,
a fibrotic tissue in fibrosis in the liver, the kidney, or the lung,
a tissue under rejection of organ transplantation,
a vascular vessel or heart (cardiac muscle) in arteriosclerosis or heart failure,
a visceral fat tissue in metabolic syndrome,
a skin tissue in atopic dermatitis and other dermatitides, and
a spinal nerve in disk herniation or chronic lumbago.

Specifically expressed or specifically activated protease, or protease considered to be related to the disease condition of a target tissue (target tissue specific protease) is known for some types of target tissues. For example, WO2013/128194, WO2010/081173, and WO2009/025846 disclose protease specifically expressed in a cancer tissue. Also, J Inflamm (Lond). 2010; 7: 45, Nat Rev Immunol. 2006 July; 6 (7): 541-50, Nat Rev Drug Discov. 2014 December; 13 (12): 904-27, Respir Res. 2016 Mar. 4; 17: 23, Dis Model Mech. 2014 February; 7 (2): 193-203, and Biochim Biophys Acta. 2012 January; 1824 (1): 133-45 disclose protease considered to be related to inflammation.

In addition to the protease specifically expressed in a target tissue, there also exists protease specifically activated in a target tissue. For example, protease may be expressed in an inactive form and then converted to an active form. Many tissues contain a substance inhibiting active protease and control the activity by the process of activation and the presence of the inhibitor (Nat Rev Cancer. 2003 July; 3 (7): 489-501). In a target tissue, the active protease may be specifically activated by escaping inhibition.

The active protease can be measured by use of a method using an antibody recognizing the active protease (PNAS 2013 Jan. 2; 110 (1): 93-98) or a method of fluorescently labeling a peptide recognizable by protease so that the fluorescence is quenched before cleavage, but emitted after Cleavage (Nat Rev Drug Discov. 2010 September; 9 (9): 690-701. doi: 10.1038/nrd3053).

From one viewpoint, the term "target tissue specific protease" can refer to any of
(i) protease that is expressed at a higher level in the target tissue than in a normal tissue,
(ii) protease that has higher activity in the target tissue than in a normal tissues,
(iii) protease that is expressed at a higher level in the target cell than in a normal cell, and
(iv) protease that has higher activity in the target cell than in a normal cell.

Specific examples of the protease include, but are not limited to, cysteine protease (including cathepsin families B, L, S, etc.), aspartyl protease (cathepsins D, E, K, O, etc.), serine protease (including matriptase (including MT-SP1), cathepsins A and G, thrombin, plasmin, urokinase (uPA), tissue plasminogen activator (tPA), elastase, proteinase 3, thrombin, kallikrein, tryptase, and chymase), metalloproteinases (metalloproteinases (MMP 1-28) including both membrane-bound forms (MMP 14-17 and MMP 24-25) and secreted forms (MMP 1-13, MMP 18-23 and MMP 26-28), A disintegrin and metalloproteinases (ADAMs), A disintegrin and metalloproteinase with thrombospondin motifs (ADAMTS), meprin (meprin alpha and meprin beta), CD10 (CALLA), prostate-specific antigen (PSA), legumain, TMPRSS3, TMPRSS4, neutrophil elastase (HNE), beta secretase (BACE), fibroblast activation protein alpha (FAP), granzyme B, guanidinobenzoatase (GB), hepsin, neprilysin, NS3/4A, HCV-NS3/4, calpain, ADAMDEC1, renin, cathepsin C, cathepsin V/L2, cathepsin X/Z/P, cruzipain, otubain 2, kallikrein-related peptidases (KLKs (KLK3, KLK4, KLK5, KLK6, KLK7, KLK8, KLK10, KLK11, KLK13, and KLK14)), bone morphogenetic protein 1 (BMP-1), activated protein C, blood coagulation-related proteases (Factor VIIa, Factor IXa, Factor Xa, Factor XIa, and Factor XIIa), HtrA1, lactoferrin, marapsin, PACE4, DESC1, dipeptidyl peptidase 4 (DPP-4), TMPRSS2, cathepsin F, cathepsin H, cathepsin L2, cathepsin 0, cathepsin S, granzyme A, Gepsin calpain 2, glutamate carboxypeptidase 2, AMSH-like proteases, AMSH, gamma secretase, antiplasmin cleaving enzyme (APCE), decysin 1, N-acetylated alpha-linked acidic dipeptidase-like 1 (NAALADL1), and furin.

From another viewpoint, the target tissue specific protease can refer to a cancer tissue specific protease or an inflammatory tissue specific protease.

Examples of cancer tissue specific protease include protease specifically expressed in a cancer tissue disclosed in WO2013/128194, WO2010/081173, and WO2009/025846.

As for the type of cancer tissue specific protease, the protease having higher expression specificity in the cancer tissue to be treated is more effective for reducing side effects. Preferable cancer tissue specific protease has a concentration in the cancer tissue 5 times or higher, more preferably 10 times or higher, further preferably 100 times or higher, particularly preferably 500 times or higher, most preferably 1000 times or higher than its concentration in a normal tissue. Also, preferable cancer tissue specific protease has activity in the cancer tissue twice or higher, more preferably 3 times or higher, 4 times or higher, 5 times or higher, or 10 times or higher, further preferably 100 times or higher, particularly preferably 500 times or higher, and most preferably 1000 times or higher than its activity in a normal tissue.

The cancer tissue specific protease may be in a form bound with a cancer cell membrane or may be in a form secreted extracellularly without being bound with a cell membrane. When the cancer tissue specific protease is not bound with a cancer cell membrane, it is preferred for immunocyte-mediated cytotoxicity to be specific for cancer cells that the cancer tissue specific protease should exist within or in the vicinity of the cancer tissue. In the present specification, the "vicinity of the cancer tissue" means to fall within the scope of location where the protease cleavage sequence specific for the cancer tissue is cleaved so that the antigen-binding domain exerts antigen-binding activity. However, it is preferred that damage on normal cells should be minimized in this scope of location.

From an alternative viewpoint, cancer tissue specific protease is any of
 (i) protease that is expressed at a higher level in the cancer tissue than in a normal tissue,
 (ii) protease that has higher activity in the cancer tissue than in a normal tissue,
 (iii) protease that is expressed at a higher level in the cancer cell than in a normal cell, and
 (iv) protease that has higher activity in the cancer cell than in a normal cell.

One type of cancer tissue specific protease may be used alone, or two or more types of cancer tissue specific proteases may be combined. The number of types of cancer tissue specific protease can be appropriately set by those skilled in the art in consideration of the cancer type to be treated.

From these viewpoints, cancer tissue specific protease is preferably serine proteases or metalloproteinases, more preferably matriptases (including MT-SP1), urokinase (uPA), or metalloproteinases, and further preferably MT-SP1, uPA, MMP-2, or MMP-9, among the proteases listed above.

As for the type of inflammatory tissue specific protease, the protease having higher expression specificity in the inflammatory tissue to be treated is more effective for reducing side effects. Preferable inflammatory tissue specific protease has a concentration in the inflammatory tissue a 5 times or higher, more preferably 10 times or higher, further preferably 100 times or higher, particularly preferably 500 times or higher, and most preferably 1000 times or higher than its concentration in normal tissues. Also, preferable inflammatory tissue specific protease has activity in the inflammatory tissues at least 2 times, more preferably 3 times or higher, 4 times or higher, 5 times or higher, or 10 times or higher, further preferably 100 times or higher, particularly preferably 500 times or higher, and most preferably 1000 times or higher than its activity in a normal tissue.

The inflammatory tissue specific protease may be in a form bound with an inflammatory cell membrane or may be in a form secreted extracellularly without being bound with a cell membrane. When the inflammatory tissue specific protease is not bound with an inflammatory cell membrane, it is preferred for immunocyte-mediated cytotoxicity to be specific for inflammatory cells that the inflammatory tissue specific protease should exist within or in the vicinity of the inflammatory tissue. In the present specification, the "vicinity of the inflammatory tissue" means to fall within the scope of location where the protease cleavage sequence specific for the inflammatory tissue is cleaved so that the antigen-binding domain exerts antigen-binding activity. However, it is preferred that damage on normal cells should be minimized in this scope of location.

From an alternative viewpoint, inflammatory tissue specific protease is any of
 (i) protease that is expressed at a higher level in the inflammatory tissue than in a normal tissue,
 (ii) protease that has higher activity in the inflammatory tissue than in a normal tissue,
 (iii) protease that is expressed at a higher level in the inflammatory cell than in a normal cell, and
 (iv) protease that has higher activity in the inflammatory cell than in a normal cell.

One type of inflammatory tissue specific protease may be used alone, or two or more types of inflammatory tissue specific proteases may be combined. The number of types of inflammatory tissue specific protease can be appropriately set by those skilled in the art in consideration of the pathological condition to be treated.

From these viewpoints, t inflammatory tissue specific protease is preferably metalloproteinase among the proteases listed above. The metalloproteinase is more preferably ADAMTS5, MMP-2, MMP-7, MMP-9, or MMP-13.

The protease cleavage sequence is a particular amino acid sequence that is specifically recognized by target tissue specific protease when the polypeptide is hydrolyzed by the target tissue specific protease in an aqueous solution.

The protease cleavage sequence is preferably an amino acid sequence that is hydrolyzed with high specificity by target tissue specific protease more specifically expressed in the target tissue or cells to be treated or more specifically activated in the target tissue/cells to be treated, from the viewpoint of reduction in side effects.

Specific examples of the protease cleavage sequence include target sequences that are specifically hydrolyzed by the above-listed protease specifically expressed in a cancer tissue disclosed in WO2013/128194, WO2010/081173, and WO2009/025846, the protease specific for an inflammatory tissue, and the like. A sequence artificially altered by, for example, introducing an appropriate amino acid mutation to a target sequence that is specifically hydrolyzed by known protease can also be used. Alternatively, a protease cleavage sequence identified by a method known to those skilled in the art as described in Nature Biotechnology 19, 661-667 (2001) may be used.

Furthermore, a naturally occurring protease cleavage sequence may be used. For example, TGFβ is converted to a latent form by protease cleavage. Likewise, a protease cleavage sequence in a protein that changes its molecular form by protease cleavage can also be used.

Examples of the protease cleavage sequence that can be used include, but are not limited to, sequences disclosed in WO2015/116933, WO2015/048329, WO2016/118629, WO2016/179257, WO2016/179285, WO2016/179335, WO2016/179003, WO2016/046778, WO2016/014974, U.S. Patent Publication No. US2016/0289324, U.S. Patent Publication No. US2016/0311903, PNAS (2000) 97: 7754-7759, Biochemical Journal (2010) 426: 219-228, and Beilstein J Nanotechnol. (2016) 7: 364-373.

The protease cleavage sequence is more preferably an amino acid sequence that is specifically hydrolyzed by suitable target tissue specific protease as mentioned above. The amino acid sequence that is specifically hydrolyzed by target tissue specific protease is preferably a sequence comprising any of the following amino acid sequences:

```
LSGRSDNH, (SEQ ID NO: 12, cleavable by MT-SP1
or uPA)

PLALAG, (SEQ ID NO: 25, cleavable by MMP-2 or
MMP-9)
and

VPLSLTMG. (SEQ ID NO: 26, cleavable by MMP-7)
```

Any of the following sequences can also be used as the protease cleavage sequence:

```
TSTSGRSANPRG, (SEQ ID NO: 74, cleavable by MT-SP1 or uPA)

ISSGLLSGRSDNH, (SEQ ID NO: 75, cleavable by MT-SP1 or uPA)

AVGLLAPPGGLSGRSDNH, (SEQ ID NO: 76, cleavable by MT-SP1 or uPA)

GAGVPMSMRGGAG, (SEQ ID NO: 77, cleavable by MMP1)

GAGIPVSLRSGAG, (SEQ ID NO: 78, cleavable by MMP2)

GPLGIAGQ, (SEQ ID NO: 79, cleavable by MMP-2)

GGPLGMLSQS, (SEQ ID NO: 80, cleavable by MMP-2)

PLGLWA, (SEQ ID NO: 81, cleavable by MMP-2)

GAGRPFSMIMGAG, (SEQ ID NO: 82, cleavable by MMP-3)

GAGVPLSLTMGAG, (SEQ ID NO: 83, cleavable by MMP-7)

GAGVPLSLYSGAG, (SEQ ID NO: 84, cleavable by MMP-9)

AANLRN, (SEQ ID NO: 85, cleavable by MMP-11)

AQAYVK, (SEQ ID NO: 86, cleavable by MMP-11)

AANYMR, (SEQ ID NO: 87, cleavable by MMP-11)

AAALTR, (SEQ ID NO: 88, cleavable by MMP-11)

AQNLMR, (SEQ ID NO: 89, cleavable by MMP-11)

AANYTK, (SEQ ID NO: 90, cleavable by MMP-11)

GAGPQGLAGQRGIVAG, (SEQ ID NO: 91, cleavable by MMP-13)

PRFKIIGG, (SEQ ID NO: 92, cleavable by pro-urokinase)

PRFRIIGG, (SEQ ID NO: 93, cleavable by pro-urokinase)

GAGSGRSAG, (SEQ ID NO: 94, cleavable by uPA)

SGRSA, (SEQ ID NO: 95, cleavable by uPA)

GSGRSA, (SEQ ID NO: 96, cleavable by uPA)

SGKSA, (SEQ ID NO: 97, cleavable by uPA)

SGRSS, (SEQ ID NO: 98, cleavable by uPA)

SGRRA, (SEQ ID NO: 99, cleavable by uPA)

SGRNA, (SEQ ID NO: 100, cleavable by uPA)

SGRKA, (SEQ ID NO: 101, cleavable by uPA)

QRGRSA, (SEQ ID NO: 102, cleavable by tPA)

GAGSLLKSRMVPNFNAG, (SEQ ID NO: 103, cleavable by cathepsin B)

TQGAAA, (SEQ ID NO: 104, cleavable by cathepsin B)

GAAAAA, (SEQ ID NO: 105, cleavable by cathepsin B)
```

-continued

GAGAAG, (SEQ ID NO: 106, cleavable by cathepsin B)

AAAAAG, (SEQ ID NO: 107, cleavable by cathepsin B)

LCGAAI, (SEQ ID NO: 108, cleavable by cathepsin B)

FAQALG, (SEQ ID NO: 109, cleavable by cathepsin B)

LLQANP, (SEQ ID NO: 110, cleavable by cathepsin B)

LAAANP, (SEQ ID NO: 111, cleavable by cathepsin B)

LYGAQF, (SEQ ID NO: 112, cleavable by cathepsin B)

LSQAQG, (SEQ ID NO: 113, cleavable by cathepsin B)

ASAASG, (SEQ ID NO: 114, cleavable by cathepsin B)

FLGASL, (SEQ ID NO: 115, cleavable by cathepsin B)

AYGATG, (SEQ ID NO: 116, cleavable by cathepsin B)

LAQATG, (SEQ ID NO: 117, cleavable by cathepsin B)

GAGSGVVIATVIVITAG, (SEQ ID NO: 118, cleavable by cathepsin L)

APMAEGGG, (SEQ ID NO: 119, cleavable by meprin alpha or meprin beta)

EAQGDKII, (SEQ ID NO: 120, cleavable by meprin alpha or meprin beta)

LAFSDAGP, (SEQ ID NO: 121, cleavable by meprin alpha or meprin beta)

YVADAPK, (SEQ ID NO: 122, cleavable by meprin alpha or meprin beta)

RRRRR, (SEQ ID NO: 123, cleavable by furin)

RRRRRR, (SEQ ID NO: 124, cleavable by furin)

GQSSRHRRAL, (SEQ ID NO: 125, cleavable by furin)

SSRHRRALD, (SEQ ID NO: 126)

RKSSIIIRMRDVVL, (SEQ ID NO: 127, cleavable by plasminogen)

SSSFDKGKYKKGDDA, (SEQ ID NO: 128, cleavable by staphylokinase)

SSSFDKGKYKRGDDA, (SEQ ID NO: 129, cleavable by staphylokinase)

IEGR, (SEQ ID NO: 130, cleavable by Factor Xa)

IDGR, (SEQ ID NO: 131, cleavable by Factor Xa)

GGSIDGR, (SEQ ID NO: 132, cleavable by Factor Xa)

GPQGIAGQ, (SEQ ID NO: 133, cleavable by collagenase)

GPQGLLGA, (SEQ ID NO: 134, cleavable by collagenase)

GIAGQ, (SEQ ID NO: 135, cleavable by collagenase)

GPLGIAG, (SEQ ID NO: 136, cleavable by collagenase)

GPEGLRVG, (SEQ ID NO: 137, cleavable by collagenase)

YGAGLGVV, (SEQ ID NO: 138, cleavable by collagenase)

AGLGVVER, (SEQ ID NO: 139, cleavable by collagenase)

AGLGISST, (SEQ ID NO: 140, cleavable by collagenase)

EPQALAMS, (SEQ ID NO: 141, cleavable by collagenase)

QALAMSAI, (SEQ ID NO: 142, cleavable by collagenase)

AAYHLVSQ, (SEQ ID NO: 143, cleavable by collagenase)

MDAFLESS, (SEQ ID NO: 144, cleavable by collagenase)

ESLPVVAV, (SEQ ID NO: 145, cleavable by collagenase)

SAPAVESE, (SEQ ID NO: 146, cleavable by collagenase)

-continued

DVAQFVLT, (SEQ ID NO: 147, cleavable by collagenase)

VAQFVLTE, (SEQ ID NO: 148, cleavable by collagenase)

AQFVLTEG, (SEQ ID NO: 149, cleavable by collagenase)

PVQPIGPQ, (SEQ ID NO: 150, cleavable by collagenase)

LVPRGS, (SEQ ID NO: 151, cleavable by thrombin)

TSGSGRSANARG, (SEQ ID NO: 168, cleavable by uPA and MT-SP1)

TSQSGRSANQRG, (SEQ ID NO: 169, cleavable by uPA and MT-SP1)

TSPSGRSAYPRG, (SEQ ID NO: 170, cleavable by uPA and MT-SP1)

TSGSGRSATPRG, (SEQ ID NO: 171, cleavable by uPA and MT-SP1)

TSQSGRSATPRG, (SEQ ID NO: 172, cleavable by uPA and MT-SP1)

TSASGRSATPRG, (SEQ ID NO: 173, cleavable by uPA and MT-SP1)

TSYSGRSAVPRG, (SEQ ID NO: 174, cleavable by uPA and MT-SP1)

TSYSGRSANFRG, (SEQ ID NO: 175, cleavable by uPA and MT-SP1)

TSSSGRSATPRG, (SEQ ID NO: 176, cleavable by uPA and MT-SP1)

TSTTGRSASPRG, (SEQ ID NO: 177, cleavable by uPA and MT-SP1) and

TSTSGRSANPRG. (SEQ ID NO: 178, cleavable by uPA and MT-SP1)

The sequences shown in Table 1 may also be used as protease cleavage sequences.

TABLE 1

Protease Cleavage Sequences (cleavable by uPA and MT-SP1)

| SEQ ID NO | Cleavage sequence | SEQ ID NO | Cleavage sequence |
|---|---|---|---|
| 208 | TSASGRSANPRG | 507 | ASGRSANP |
| 209 | TSESGRSANPRG | 508 | ESGRSANP |
| 210 | TSFSGRSANPRG | 509 | FSGRSANP |
| 211 | TSGSGRSANPRG | 510 | GSGRSANP |
| 212 | TSHSGRSANPRG | 511 | HSGRSANP |
| 213 | TSKSGRSANPRG | 512 | KSGRSANP |
| 214 | TSMSGRSANPRG | 513 | MSGRSANP |
| 215 | TSNSGRSANPRG | 514 | NSGRSANP |
| 216 | TSPSGRSANPRG | 515 | PSGRSANP |
| 217 | TSQSGRSANPRG | 516 | QSGRSANP |
| 218 | TSWSGRSANPRG | 517 | WSGRSANP |
| 219 | TSYSGRSANPRG | 518 | YSGRSANP |
| 220 | TSTAGRSANPRG | 519 | TAGRSANP |
| 221 | TSTDGRSANPRG | 520 | TDGRSANP |
| 222 | TSTEGRSANPRG | 521 | TEGRSANP |
| 223 | TSTFGRSANPRG | 522 | TFGRSANP |

TABLE 1-continued

Protease Cleavage Sequences (cleavable by uPA and MT-SP1)

| SEQ ID NO | Cleavage sequence | SEQ ID NO | Cleavage sequence |
|---|---|---|---|
| 224 | TSTLGRSANPRG | 523 | TLGRSANP |
| 225 | TSTMGRSANPRG | 524 | TMGRSANP |
| 226 | TSTPGRSANPRG | 525 | TPGRSANP |
| 227 | TSTQGRSANPRG | 526 | TQGRSANP |
| 228 | TSTVGRSANPRG | 527 | TVGRSANP |
| 229 | TSTWGRSANPRG | 528 | TWGRSANP |
| 230 | TSTSARSANPRG | 529 | TSARSANP |
| 231 | TSTSERSANPRG | 530 | TSERSANP |
| 232 | TSTSFRSANPRG | 531 | TSFRSANP |
| 233 | TSTSHRSANPRG | 532 | TSHRSANP |
| 234 | TSTSIRSANPRG | 533 | TSIRSANP |
| 235 | TSTSKRSANPRG | 534 | TSKRSANP |
| 236 | TSTSLRSANPRG | 535 | TSLRSANP |
| 237 | TSTSMRSANPRG | 536 | TSMRSANP |
| 238 | TSTSNRSANPRG | 537 | TSNRSANP |
| 239 | TSTSPRSANPRG | 538 | TSPRSANP |
| 240 | TSTSQRSANPRG | 539 | TSQRSANP |
| 241 | TSTSRRSANPRG | 540 | TSRRSANP |

TABLE 1-continued

Protease Cleavage Sequences
(cleavable by uPA and MT-SP1)

| SEQ ID NO | Cleavage sequence | SEQ ID NO | Cleavage sequence |
|---|---|---|---|
| 242 | TSTSTRSANPRG | 541 | TSTRSANP |
| 243 | TSTSVRSANPRG | 542 | TSVRSANP |
| 244 | TSTSWRSANPRG | 543 | TSWRSANP |
| 245 | TSTSYRSANPRG | 544 | TSYRSANP |
| 246 | TSTSGRAANPRG | 545 | TSGRAANP |
| 247 | TSTSGRDANPRG | 546 | TSGRDANP |
| 248 | TSTSGREANPRG | 547 | TSGREANP |
| 249 | TSTSGRGANPRG | 548 | TSGRGANP |
| 250 | TSTSGRHANPRG | 549 | TSGRHANP |
| 251 | TSTSGRIANPRG | 550 | TSGRIANP |
| 252 | TSTSGRKANPRG | 551 | TSGRKANP |
| 253 | TSTSGRLANPRG | 552 | TSGRLANP |
| 254 | TSTSGRMANPRG | 553 | TSGRMANP |
| 255 | TSTSGRNANPRG | 554 | TSGRNANP |
| 256 | TSTSGRPANPRG | 555 | TSGRPANP |
| 257 | TSTSGRQANPRG | 556 | TSGRQANP |
| 258 | TSTSGRRANPRG | 557 | TSGRRANP |
| 259 | TSTSGRTANPRG | 558 | TSGRTANP |
| 260 | TSTSGRVANPRG | 559 | TSGRVANP |
| 261 | TSTSGRWANPRG | 560 | TSGRWANP |
| 262 | TSTSGRYANPRG | 561 | TSGRYANP |
| 263 | TSTSGRSENPRG | 562 | TSGRSENP |
| 264 | TSTSGRSFNPRG | 563 | TSGRSFNP |
| 265 | TSTSGRSKNPRG | 564 | TSGRSKNP |
| 266 | TSTSGRSMNPRG | 565 | TSGRSMNP |
| 267 | TSTSGRSNNPRG | 566 | TSGRSNNP |
| 268 | TSTSGRSPNPRG | 567 | TSGRSPNP |
| 269 | TSTSGRSQNPRG | 568 | TSGRSQNP |
| 270 | TSTSGRSRNPRG | 569 | TSGRSRNP |
| 271 | TSTSGRSSNPRG | 570 | TSGRSSNP |
| 272 | TSTSGRSWNPRG | 571 | TSGRSWNP |
| 273 | TSTSGRSYNPRG | 572 | TSGRSYNP |
| 274 | TSTSGRSAAPRG | 573 | TSGRSAAP |
| 275 | TSTSGRSADPRG | 574 | TSGRSADP |
| 276 | TSTSGRSAEPRG | 575 | TSGRSAEP |
| 277 | TSTSGRSAFPRG | 576 | TSGRSAFP |
| 278 | TSTSGRSAGPRG | 577 | TSGRSAGP |
| 279 | TSTSGRSAKPRG | 578 | TSGRSAKP |
| 280 | TSTSGRSALPRG | 579 | TSGRSALP |
| 281 | TSTSGRSAMPRG | 580 | TSGRSAMP |
| 282 | TSTSGRSAPPRG | 581 | TSGRSAPP |
| 283 | TSTSGRSAQPRG | 582 | TSGRSAQP |
| 284 | TSTSGRSAVPRG | 583 | TSGRSAVP |
| 285 | TSTSGRSAWPRG | 584 | TSGRSAWP |
| 286 | TSTSGRSAYPRG | 585 | TSGRSAYP |
| 287 | TSTSGRSANARG | 586 | TSGRSANA |
| 288 | TSTSGRSANDRG | 587 | TSGRSAND |
| 289 | TSTSGRSANERG | 588 | TSGRSANE |
| 290 | TSTSGRSANFRG | 589 | TSGRSANF |
| 291 | TSTSGRSANGRG | 590 | TSGRSANG |
| 292 | TSTSGRSANIRG | 591 | TSGRSANI |
| 293 | TSTSGRSANKRG | 592 | TSGRSANK |
| 294 | TSTSGRSANNRG | 593 | TSGRSANN |
| 295 | TSTSGRSANQRG | 594 | TSGRSANQ |
| 296 | TSTSGRSANSRG | 595 | TSGRSANS |
| 297 | TSTSGRSANTRG | 596 | TSGRSANT |
| 298 | TSTSGRSANWRG | 597 | TSGRSANW |
| 299 | TSDSGRSANPRG | 598 | DSGRSANP |
| 300 | TSISGRSANPRG | 599 | ISGRSANP |
| 301 | TSSSGRSANPRG | 600 | SSGRSANP |
| 302 | TSTHGRSANPRG | 601 | THGRSANP |
| 303 | TSTKGRSANPRG | 602 | TKGRSANP |
| 304 | TSTTGRSANPRG | 603 | TTGRSANP |
| 305 | TSTYGRSANPRG | 604 | TYGRSANP |
| 306 | TSTSDRSANPRG | 605 | TSDRSANP |
| 307 | TSTSSRSANPRG | 606 | TSSRSANP |
| 308 | TSTSGRFANPRG | 607 | TSGRFANP |
| 309 | TSTSGRSDNPRG | 608 | TSGRSDNP |
| 310 | TSTSGRSHNPRG | 609 | TSGRSHNP |
| 311 | TSTSGRSINPRG | 610 | TSGRSINP |
| 312 | TSTSGRSLNPRG | 611 | TSGRSLNP |
| 313 | TSTSGRSTNPRG | 612 | TSGRSTNP |
| 314 | TSTSGRSVNPRG | 613 | TSGRSVNP |

TABLE 1-continued

Protease Cleavage Sequences
(cleavable by uPA and MT-SP1)

| SEQ ID NO | Cleavage sequence | SEQ ID NO | Cleavage sequence |
|---|---|---|---|
| 315 | TSTSGRSAHPRG | 614 | TSGRSAHP |
| 316 | TSTSGRSAIPRG | 615 | TSGRSAIP |
| 317 | TSTSGRSARPRG | 616 | TSGRSARP |
| 318 | TSTSGRSASPRG | 617 | TSGRSASP |
| 319 | TSTSGRSATPRG | 618 | TSGRSATP |
| 320 | TSTSGRSANHRG | 619 | TSGRSANH |
| 321 | TSTSGRSANLRG | 620 | TSGRSANL |
| 322 | TSTSGRSANMRG | 621 | TSGRSANM |
| 323 | TSTSGRSANRRG | 622 | TSGRSANR |
| 324 | TSTSGRSANVRG | 623 | TSGRSANV |
| 325 | TSTSGRSANYRG | 624 | TSGRSANY |
| 326 | TSGSGRSAVPRG | 625 | GSGRSAVP |
| 327 | TSGSGRSAYPRG | 626 | GSGRSAYP |
| 328 | TSGSGRSANQRG | 627 | GSGRSANQ |
| 168 | TSGSGRSANARG | 628 | GSGRSANA |
| 329 | TSGSGRSANIRG | 629 | GSGRSANI |
| 330 | TSGSGRSANFRG | 630 | GSGRSANF |
| 331 | TSGSGRSANSRG | 631 | GSGRSANS |
| 332 | TSQSGRSAVPRG | 632 | QSGRSAVP |
| 333 | TSQSGRSAYPRG | 633 | QSGRSAYP |
| 169 | TSQSGRSANQRG | 634 | QSGRSANQ |
| 334 | TSQSGRSANARG | 635 | QSGRSANA |
| 335 | TSQSGRSANIRG | 636 | QSGRSANI |
| 336 | TSQSGRSANFRG | 637 | QSGRSANF |
| 337 | TSQSGRSANSRG | 638 | QSGRSANS |
| 338 | TSPSGRSAVPRG | 639 | PSGRSAVP |
| 170 | TSPSGRSAYPRG | 640 | PSGRSAYP |
| 339 | TSPSGRSANQRG | 641 | PSGRSANQ |
| 340 | TSPSGRSANARG | 642 | PSGRSANA |
| 341 | TSPSGRSANIRG | 643 | PSGRSANI |
| 342 | TSPSGRSANFRG | 644 | PSGRSANF |
| 343 | TSPSGRSANSRG | 645 | PSGRSANS |
| 344 | TSASGRSAVPRG | 646 | ASGRSAVP |
| 345 | TSASGRSAYPRG | 647 | ASGRSAYP |
| 346 | TSASGRSANQRG | 648 | ASGRSANQ |
| 347 | TSASGRSANARG | 649 | ASGRSANA |
| 348 | TSASGRSANIRG | 650 | ASGRSANI |
| 349 | TSASGRSANFRG | 651 | ASGRSANF |
| 350 | TSASGRSANSRG | 652 | ASGRSANS |
| 351 | TSYSGRSENPRG | 653 | YSGRSENP |
| 352 | TSGSGRSENPRG | 654 | GSGRSENP |
| 353 | TSQSGRSENPRG | 655 | QSGRSENP |
| 354 | TSPSGRSENPRG | 656 | PSGRSENP |
| 355 | TSASGRSENPRG | 657 | ASGRSENP |
| 356 | TSHSGRSENPRG | 658 | HSGRSENP |
| 357 | TSTSGRSENQRG | 659 | TSGRSENQ |
| 358 | TSTSGRSENARG | 660 | TSGRSENA |
| 359 | TSTSGRSENIRG | 661 | TSGRSENI |
| 360 | TSTSGRSENFRG | 662 | TSGRSENF |
| 361 | TSTSGRSENSRG | 663 | TSGRSENS |
| 362 | TSYSGRSAEPRG | 664 | YSGRSAEP |
| 363 | TSGSGRSAEPRG | 665 | GSGRSAEP |
| 364 | TSQSGRSAEPRG | 666 | QSGRSAEP |
| 365 | TSPSGRSAEPRG | 667 | PSGRSAEP |
| 366 | TSASGRSAEPRG | 668 | ASGRSAEP |
| 367 | TSHSGRSAEPRG | 669 | HSGRSAEP |
| 368 | TSTSGRSAEQRG | 670 | TSGRSAEQ |
| 369 | TSTSGRSAEARG | 671 | TSGRSAEA |
| 370 | TSTSGRSAEIRG | 672 | TSGRSAEI |
| 371 | TSTSGRSAEFRG | 673 | TSGRSAEF |
| 372 | TSTSGRSAESRG | 674 | TSGRSAES |
| 373 | TSGTGRSANPRG | 675 | GTGRSANP |
| 374 | TSGKGRSANPRG | 676 | GKGRSANP |
| 375 | TSGSGRSAIPRG | 677 | GSGRSAIP |
| 171 | TSGSGRSATPRG | 678 | GSGRSATP |
| 376 | TSGSGRSASPRG | 679 | GSGRSASP |
| 377 | TSGSGRSAHPRG | 680 | GSGRSAHP |
| 378 | TSGSGRSANYRG | 681 | GSGRSANY |
| 379 | TSGSGRSANVRG | 682 | GSGRSANV |
| 380 | TSGSGRSANHRG | 683 | GSGRSANH |
| 381 | TSQTGRSANPRG | 684 | QTGRSANP |
| 382 | TSQKGRSANPRG | 685 | QKGRSANP |
| 383 | TSQSGRSAIPRG | 686 | QSGRSAIP |

TABLE 1-continued

Protease Cleavage Sequences (cleavable by uPA and MT-SP1)

| SEQ ID NO | Cleavage sequence | SEQ ID NO | Cleavage sequence |
|---|---|---|---|
| 172 | TSQSGRSATPRG | 687 | QSGRSATP |
| 384 | TSQSGRSASPRG | 688 | QSGRSASP |
| 385 | TSQSGRSAHPRG | 689 | QSGRSAHP |
| 386 | TSQSGRSANYRG | 690 | QSGRSANY |
| 387 | TSQSGRSANVRG | 691 | QSGRSANV |
| 388 | TSQSGRSANHRG | 692 | QSGRSANH |
| 389 | TSPTGRSANPRG | 693 | PTGRSANP |
| 390 | TSPKGRSANPRG | 694 | PKGRSANP |
| 391 | TSPSGRSAIPRG | 695 | PSGRSAIP |
| 392 | TSPSGRSATPRG | 696 | PSGRSATP |
| 393 | TSPSGRSASPRG | 697 | PSGRSASP |
| 394 | TSPSGRSAHPRG | 698 | PSGRSAHP |
| 395 | TSPSGRSANYRG | 699 | PSGRSANY |
| 396 | TSPSGRSANVRG | 700 | PSGRSANV |
| 397 | TSPSGRSANHRG | 701 | PSGRSANH |
| 398 | TSATGRSANPRG | 702 | ATGRSANP |
| 399 | TSAKGRSANPRG | 703 | AKGRSANP |
| 400 | TSASGRSAIPRG | 704 | ASGRSAIP |
| 173 | TSASGRSATPRG | 705 | ASGRSATP |
| 401 | TSASGRSASPRG | 706 | ASGRSASP |
| 402 | TSASGRSAHPRG | 707 | ASGRSAHP |
| 403 | TSASGRSANYRG | 708 | ASGRSANY |
| 404 | TSASGRSANVRG | 709 | ASGRSANV |
| 405 | TSASGRSANHRG | 710 | ASGRSANH |
| 406 | TSYTGRSANPRG | 711 | YTGRSANP |
| 407 | TSYKGRSANPRG | 712 | YKGRSANP |
| 174 | TSYSGRSAVPRG | 713 | YSGRSAVP |
| 408 | TSYSGRSAIPRG | 714 | YSGRSAIP |
| 409 | TSYSGRSATPRG | 715 | YSGRSATP |
| 410 | TSYSGRSASPRG | 716 | YSGRSASP |
| 411 | TSYSGRSAHPRG | 717 | YSGRSAHP |
| 412 | TSYSGRSANARG | 718 | YSGRSANA |
| 175 | TSYSGRSANFRG | 719 | YSGRSANF |
| 413 | TSYSGRSANYRG | 720 | YSGRSANY |
| 414 | TSYSGRSANVRG | 721 | YSGRSANV |
| 415 | TSYSGRSANHRG | 722 | YSGRSANH |
| 416 | TSSTGRSANPRG | 723 | STGRSANP |
| 417 | TSSKGRSANPRG | 724 | SKGRSANP |
| 418 | TSSSGRSAVPRG | 725 | SSGRSAVP |
| 419 | TSSSGRSAIPRG | 726 | SSGRSAIP |
| 176 | TSSSGRSATPRG | 727 | SSGRSATP |
| 420 | TSSSGRSASPRG | 728 | SSGRSASP |
| 421 | TSSSGRSAHPRG | 729 | SSGRSAHP |
| 422 | TSSSGRSANARG | 730 | SSGRSANA |
| 423 | TSSSGRSANFRG | 731 | SSGRSANF |
| 424 | TSSSGRSANYRG | 732 | SSGRSANY |
| 425 | TSSSGRSANVRG | 733 | SSGRSANV |
| 426 | TSSSGRSANHRG | 734 | SSGRSANH |
| 427 | TSITGRSANPRG | 735 | ITGRSANP |
| 428 | TSIKGRSANPRG | 736 | IKGRSANP |
| 429 | TSISGRSAVPRG | 737 | ISGRSAVP |
| 430 | TSISGRSAIPRG | 738 | ISGRSAIP |
| 431 | TSISGRSATPRG | 739 | ISGRSATP |
| 432 | TSISGRSASPRG | 740 | ISGRSASP |
| 433 | TSISGRSAHPRG | 741 | ISGRSAHP |
| 434 | TSISGRSANARG | 742 | ISGRSANA |
| 435 | TSISGRSANFRG | 743 | ISGRSANF |
| 436 | TSISGRSANYRG | 744 | ISGRSANY |
| 437 | TSISGRSANVRG | 745 | ISGRSANV |
| 438 | TSISGRSANHRG | 746 | ISGRSANH |
| 439 | TSTTGRSAVPRG | 747 | TTGRSAVP |
| 440 | TSTTGRSAIPRG | 748 | TTGRSAIP |
| 441 | TSTTGRSATPRG | 749 | TTGRSATP |
| 177 | TSTTGRSASPRG | 750 | TTGRSASP |
| 442 | TSTTGRSAHPRG | 751 | TTGRSAHP |
| 443 | TSTTGRSANARG | 752 | TTGRSANA |
| 444 | TSTTGRSANFRG | 753 | TTGRSANF |
| 445 | TSTTGRSANYRG | 754 | TTGRSANY |
| 446 | TSTTGRSANVRG | 755 | TTGRSANV |
| 447 | TSTTGRSANHRG | 756 | TTGRSANH |
| 448 | TSTKGRSAVPRG | 757 | TKGRSAVP |
| 449 | TSTKGRSAIPRG | 758 | TKGRSAIP |
| 450 | TSTKGRSATPRG | 759 | TKGRSATP |

TABLE 1-continued

Protease Cleavage Sequences
(cleavable by uPA and MT-SP1)

| SEQ ID NO | Cleavage sequence | SEQ ID NO | Cleavage sequence |
|---|---|---|---|
| 451 | TSTKGRSASPRG | 760 | TKGRSASP |
| 452 | TSTKGRSAHPRG | 761 | TKGRSAHP |
| 453 | TSTKGRSANARG | 762 | TKGRSANA |
| 454 | TSTKGRSANFRG | 763 | TKGRSANF |
| 455 | TSTKGRSANYRG | 764 | TKGRSANY |
| 456 | TSTKGRSANVRG | 765 | TKGRSANV |
| 457 | TSTKGRSANHRG | 766 | TKGRSANH |
| 458 | TSTSGRSAVYRG | 767 | TSGRSAVY |
| 459 | TSTSGRSAVVRG | 768 | TSGRSAVV |
| 460 | TSTSGRSAVHRG | 769 | TSGRSAVH |
| 461 | TSTSGRSAIYRG | 770 | TSGRSAIY |
| 462 | TSTSGRSAIVRG | 771 | TSGRSAIV |
| 463 | TSTSGRSAIHRG | 772 | TSGRSAIH |
| 464 | TSTSGRSASYRG | 773 | TSGRSASY |
| 465 | TSTSGRSASVRG | 774 | TSGRSASV |
| 466 | TSTSGRSASHRG | 775 | TSGRSASH |
| 467 | TSTSGRSAHYRG | 776 | TSGRSAHY |
| 468 | TSTSGRSAHVRG | 777 | TSGRSAHV |
| 469 | TSTSGRSAHHRG | 778 | TSGRSAHH |
| 470 | TSPSGRSEVPRG | 779 | PSGRSEVP |
| 471 | TSPSGRSAEPRG | 780 | PSGRSAEP |
| 472 | TSPSGRSAGPRG | 781 | PSGRSAGP |
| 473 | TSASGRSENARG | 782 | ASGRSENA |
| 474 | TSASGRSAEARG | 783 | ASGRSAEA |
| 475 | TSASGRSAGARG | 784 | ASGRSAGA |
| 476 | TSGTGRSATPRG | 785 | GTGRSATP |
| 477 | TSGSGRSATYRG | 786 | GSGRSATY |
| 478 | TSGSGRSATVRG | 787 | GSGRSATV |
| 479 | TSGSGRSATHRG | 788 | GSGRSATH |
| 480 | TSGTGRSATYRG | 789 | GTGRSATY |
| 481 | TSGTGRSATVRG | 790 | GTGRSATV |
| 482 | TSGTGRSATHRG | 791 | GTGRSATH |
| 483 | TSGSGRSETPRG | 792 | GSGRSETP |
| 484 | TSGTGRSETPRG | 793 | GTGRSETP |
| 485 | TSGSGRSETYRG | 794 | GSGRSETY |
| 486 | TSGSGRSETVRG | 795 | GSGRSETV |
| 487 | TSGSGRSETHRG | 796 | GSGRSETH |
| 488 | TSYTGRSAVPRG | 797 | YTGRSAVP |
| 489 | TSYSGRSAVYRG | 798 | YSGRSAVY |
| 490 | TSYSGRSAVVRG | 799 | YSGRSAVV |
| 491 | TSYSGRSAVHRG | 800 | YSGRSAVH |
| 492 | TSYTGRSAVYRG | 801 | YTGRSAVY |
| 493 | TSYTGRSAVVRG | 802 | YTGRSAVV |
| 494 | TSYTGRSAVHRG | 803 | YTGRSAVH |
| 495 | TSYSGRSEVPRG | 804 | YSGRSEVP |
| 496 | TSYTGRSEVPRG | 805 | YTGRSEVP |
| 497 | TSYSGRSEVYRG | 806 | YSGRSEVY |
| 498 | TSYSGRSEVVRG | 807 | YSGRSEVV |
| 499 | TSYSGRSEVHRG | 808 | YSGRSEVH |
| 500 | TSYTGRSAVPGG | 809 | YTGRSAVP |
| 501 | TSYSGRSAVYGG | 810 | YSGRSAVY |
| 502 | TSYSGRSAVVGG | 811 | YSGRSAVV |
| 503 | TSYSGRSAVHGG | 812 | YSGRSAVH |
| 504 | TSYTGRSAVYGG | 813 | YTGRSAVY |
| 505 | TSYTGRSAVVGG | 814 | YTGRSAVV |
| 506 | TSYTGRSAVHGG | 815 | YTGRSAVH |
| 853 | TSTSGRSANPRG | 905 | TSYTGRSANPLG |
| 854 | TSTSGRSANPAG | 906 | TSYSGRSAIPLG |
| 855 | TSTSGRSANPHG | 907 | TSISGRSANYLG |
| 856 | TSTSGRSANPIG | 908 | TSPSGRSAGPLG |
| 857 | TSTSGRSANPLG | 909 | TSYTGRSAVPLG |
| 858 | TSTSGRSANPSG | 910 | TSYTGRSAVYLG |
| 859 | ISTSGRSANPIG | 911 | TSYTGRSAVVLG |
| 860 | YSTSGRSANP1G | 912 | TSYTGRSAVHLG |
| 861 | TSYSGRSAVPAG | 913 | TSYSGRSAVPSG |
| 862 | TSPSGRSANIAG | 914 | TSPSGRSANISG |
| 863 | TSPSGRSANFAG | 915 | TSPSGRSANFSG |
| 864 | TSPTGRSANPAG | 916 | TSPTGRSANPSG |
| 865 | TSPSGRSAIPAG | 917 | TSPSGRSAIPSG |
| 866 | TSYTGRSANPAG | 918 | TSYTGRSANPSG |
| 867 | TSYSGRSAIPAG | 919 | TSYSGRSAIPSG |
| 868 | TS1SGRSANYAG | 920 | TSISGRSANYSG |
| 869 | TSPSGRSAGPAG | 921 | TSPSGRSAGPSG |

TABLE 1-continued

Protease Cleavage Sequences
(cleavable by uPA and MT-SP1)

| SEQ ID NO | Cleavage sequence | SEQ ID NO | Cleavage sequence |
|---|---|---|---|
| 870 | TSYTGRSAVPAG | 922 | TSYTGRSAVPSG |
| 871 | TSYTGRSAVYAG | 923 | TSYTGRSAVYSG |
| 872 | TSYTGRSAVVAG | 924 | TSYTGRSAVVSG |
| 873 | TSYTGRSAVHAG | 925 | TSYTGRSAVHSG |
| 874 | TSYSGRSAVPHG | 926 | ISYSGRSAVPIG |
| 875 | TSPSGRSANIHG | 927 | ISPSGRSANIIG |
| 876 | TSPSGRSANFHG | 928 | ISPSGRSANFIG |
| 877 | TSPTGRSANPHG | 929 | ISPTGRSANPIG |
| 878 | TSPSGRSAIPHG | 930 | ISPSGRSAIPIG |
| 879 | TSYTGRSANPHG | 931 | ISYTGRSANPIG |
| 880 | TSYSGRSAIPHG | 932 | ISYSGRSAIPIG |
| 881 | TSISGRSANYHG | 933 | ISISGRSANYIG |
| 882 | TSPSGRSAGPHG | 934 | ISPSGRSAGPIG |
| 883 | TSYTGRSAVPHG | 935 | ISYTGRSAVPIG |
| 884 | TSYTGRSAVYHG | 936 | ISYTGRSAVYIG |
| 885 | TSYTGRSAVVHG | 937 | ISYTGRSAVVIG |
| 886 | TSYTGRSAVHHG | 938 | ISYTGRSAVHIG |
| 887 | TSYSGRSAVPIG | 939 | YSYSGRSAVPIG |
| 888 | TSPSGRSANIIG | 940 | YSPSGRSANIIG |
| 889 | TSPSGRSANFIG | 941 | YSPSGRSANFIG |
| 890 | TSPTGRSANPIG | 942 | YSPTGRSANPIG |
| 891 | TSPSGRSAIPIG | 943 | YSPSGRSAIPIG |
| 892 | TSYTGRSANPIG | 944 | YSYTGRSANPIG |
| 893 | TSYSGRSAIPIG | 945 | YSYSGRSAIPIG |
| 894 | TSISGRSANYIG | 946 | YSISGRSANYIG |
| 895 | TSPSGRSAGP1G | 947 | YSPSGRSAGPIG |
| 896 | TSYTGRSAVPIG | 948 | YSYTGRSAVPIG |

The following sequence may also be used as a protease cleavage sequence:

(SEQ ID NO: 833)
X1-X2-X3-X4-X5-X6-X7-X8 wherein, X1 to X8 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 represents R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; and X8 is an amino acid selected from A, D, E, F, G, H, I, K, L, M, N, P, Q, R, S, T, V, W and Y.

The following sequence may also be used as a protease cleavage sequence:

(SEQ ID NO: 834)
X1-X2-X3-X4-X5-X6-X7-X8 wherein, X1 to X8 each represent a single amino acid, X1 is an amino acid selected from A, E, F, G, H, K, M, N, P, Q, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; and X8 is an amino acid selected from A, D, E, F, G, H, I, K, L, M, N, P, Q, R, S, T, V, W and Y.

The following sequence may also be used as a protease cleavage sequence:

(SEQ ID NO: 835)
X1-X2-X3-X4-X5-X6-X7-X8 wherein, X1 to X8 each represent a single amino acid, X1 is an amino acid selected from A, D, E, F, G, H, I, K, M, N, P, Q, S, T, W and Y; X2 is an amino acid selected from A, D, F, L, M, P, Q, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; and X8 is an amino acid selected from A, D, E, F, G, H, I, K, L, M, N, P, Q, R, S, T, V, W and Y.

The following sequence may also be used as a protease cleavage sequence:

(SEQ ID NO: 836)
X1-X2-X3-X4-X5-X6-X7-X8 wherein, X1 to X8 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, E, F, H, I, K, L, M, N, P, Q, R, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; and X8 is an amino acid selected from A, D, E, F, G, H, I, K, L, M, N, P, Q, R, S, T, V, W and Y.

The following sequence may also be used as a protease cleavage sequence:

(SEQ ID NO: 837)
X1-X2-X3-X4-X5-X6-X7-X8 wherein, X1 to X8 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, G, H, I, K, L, M, N, Q, R, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; and X8 is an amino acid selected from A, D, E, F, G, H, I, K, L, M, N, P, Q, R, S, T, V, W and Y.

The following sequence may also be used as a protease cleavage sequence:

```
                                               (SEQ ID NO: 838)
              X1-X2-X3-X4-X5-X6-X7-X8
``` wherein, X1 to X8 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, 1, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from E, F, K, M, N, P, Q, R, S and W; X7 is an amino acid selected from A, D, E, F, G, H, I, K, L, M, N, P, Q, R, S, T, V, W and Y; and X8 is an amino acid selected from A, D, E, F, G, H, I, K, L, M, N, P, Q, R, S, T, V, W and Y.

The following sequence may also be used as a protease cleavage sequence:

```
                                               (SEQ ID NO: 839)
              X1-X2-X3-X4-X5-X6-X7-X8
``` wherein, X1 to X8 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, F, G, L, M, P, Q, V and W; and X8 is an amino acid selected from A, D, E, F, G, H, I, K, L, M, N, P, Q, R, S, T, V, W and Y.

The following sequence may also be used as a protease cleavage sequence:

```
                                               (SEQ ID NO: 840)
              X1-X2-X3-X4-X5-X6-X7-X8
``` wherein, X1 to X8 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; and X8 is an amino acid selected from A, D, E, F, G, I, K, N, T and W.

The following sequence may also be used as a protease cleavage sequence:

```
                                               (SEQ ID NO: 841)
              X1-X2-X3-X4-X5-X6-X7-X8
``` wherein, X1 to X8 each represent a single amino acid, X1 is an amino acid selected from A, G, I, P, Q, S and Y; X2 is an amino acid selected from K or T; X3 is G; X4 is R; X5 is S; X6 is A; X7 is an amino acid selected from H, I and V; and X8 is an amino acid selected from H, V and Y.

The following sequence may also be used as a protease cleavage sequence:

```
                                               (SEQ ID NO: 842)
              X1-X2-X3-X4-X5-X6-X7-X8
``` wherein, X1 to X8 each represent a single amino acid, X1 is Y; X2 is an amino acid selected from S and T; X3 is G; X4 is R; X5 is S; X6 is an amino acid selected from A and E; X7 is an amino acid selected from N and V; and X8 is an amino acid selected from H, P, V and Y.

The following sequence may also be used as a protease cleavage sequence:

```
                                               (SEQ ID NO: 843)
            X1-X2-X3-X4-X5-X6-X7-X8-X9
``` wherein, X1 to X9 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; and X9 is an amino acid selected from A, G, H, I, L and R.

The following sequence may also be used as a protease cleavage sequence:

```
                                               (SEQ ID NO: 844)
            X1-X2-X3-X4-X5-X6-X7-X8-X9
``` wherein, X1 to X9 each represent a single amino acid, X1 is an amino acid selected from A, E, F, G, H, K, M, N, P, Q, W and Y; X2 is an amino acid selected from A, D, E, F, H, K, L, M, P, Q, S, T, V, W and Y; X3 is an amino acid selected from A, D, E, F. G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; and X9 is an amino acid selected from A, G, H, I, L and R.

The following sequence may also be used as a protease cleavage sequence:

```
                                               (SEQ ID NO: 845)
            X1-X2-X3-X4-X5-X6-X7-X8-X9
``` wherein, X1 to X9 each represent a single amino acid, X1 is an amino acid selected from A, D, E, F, G, H, I, K, M, N, P, Q, S, T, W and Y; X2 is an amino acid selected from A, D, F, L, M, P, Q, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; and X9 is an amino acid selected from A, G, H, I, L and R.

The following sequence may also be used as a protease cleavage sequence:

(SEQ ID NO: 846)
X1-X2-X3-X4-X5-X6-X7-X8-X9 wherein, X1 to X9 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, E, F, H, I, K, L, M, N, P, Q, R, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; and X9 is an amino acid selected from A, G, H, I, L and R.

The following sequence may also be used as a protease cleavage sequence:

(SEQ ID NO: 847)
X1-X2-X3-X4-X5-X6-X7-X8-X9 wherein, X1 to X9 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, G, H, I, K, L, M, N, Q, R, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; and X9 is an amino acid selected from A, G, H, I, L and R.

The following sequence may also be used as a protease cleavage sequence:

(SEQ ID NO: 848)
X1-X2-X3-X4-X5-X6-X7-X8-X9 wherein, X1 to X9 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from E, F, K, M, N, P, Q, R, S and W; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; and X9 is an amino acid selected from A, G, H, I, L and R.

The following sequence may also be used as a protease cleavage sequence:

(SEQ ID NO: 849)
X1-X2-X3-X4-X5-X6-X7-X8-X9 wherein, X1 to X9 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, F, G, L, M, P, Q, V and W; X8 is an amino acid selected from A, D, E, F, G, H, I, K, L, M, N, P, Q, R, S, T, V, W and Y; and X9 is an amino acid selected from A, G, H, I, L and R.

The following sequence may also be used as a protease cleavage sequence:

(SEQ ID NO: 850)
X1-X2-X3-X4-X5-X6-X7-X8-X9 wherein, X1 to X9 each represent a single amino acid, X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, I, K, N, T and W; and X9 is an amino acid selected from A, G, H, I, L and R.

The following sequence may also be used as a protease cleavage sequence:

(SEQ ID NO: 851)
X1-X2-X3-X4-X5-X6-X7-X8-X9 wherein, X1 to X9 each represent a single amino acid, X1 is an amino acid selected from A, G, I, P, Q, S and Y; X2 is an amino acid selected from K or T; X3 is G; X4 is R; X5 is S; X6 is A; X7 is an amino acid selected from H, I and V; X8 is an amino acid selected from H, V and Y; and X9 is an amino acid selected from A, G, H, I, L and R.

The following sequence may also be used as a protease cleavage sequence:

(SEQ ID NO: 852)
X1-X2-X3-X4-X5-X6-X7-X8-X9 wherein, X1 to X9 each represent a single amino acid, X1 is Y; X2 is an amino acid selected from S and T; X3 is G; X4 is R; X5 is S; X6 is an amino acid selected from A and E; X8 is an amino acid selected from H, P, V and Y; and X9 is an amino acid selected from A, G, H, I, L and R.

The following sequence may also be used as a protease cleavage sequence:

(SEQ ID NO: 1062)
X10-X11-X1-X2-X3-X4-X5-X6-X7-X8 wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; and X8 is an amino acid selected from A, D, E, F, G, H, I, K, L, M, N, P, Q, R, S, T, V, W and Y.

The following sequence may also be used as a protease cleavage sequence:

(SEQ ID NO: 1063)
X10-X11-X1-X2-X3-X4-X5-X6-X7-X8 wherein, X1 to X11 each represent a single amino acid, X10 is an amino acid selected from I, T and Y; X11 is S; X1 is an amino acid selected from A, E, F, G, H, K, M, N, P, Q, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; and X8 is an amino acid selected from A, D, E, F, G, H, I, K, L, M, N, P, Q, R, S, T, V, W and Y.

The following sequence may also be used as a protease cleavage sequence:

(SEQ ID NO: 1064)
X10-X11-X1-X2-X3-X4-X5-X6-X7-X8 wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, F, L, M, P, Q, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, 5, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; and X8 is an amino acid selected from A, D, E, F, G, H, I, K, L, M, N, P, Q, R, S, T, V, W and Y.

The following sequence may also be used as a protease cleavage sequence:

(SEQ ID NO: 1065)
X10-X11-X1-X2-X3-X4-X5-X6-X7-X8 wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, E, F, H, I, K, L, M, N, P, Q, R, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; and X8 is an amino acid selected from A, D, E, F, G, H, I, K, L, M, N, P, Q, R, S, T, V, W and Y.

The following sequence may also be used as a protease cleavage sequence:

(SEQ ID NO: 1066)
X10-X11-X1-X2-X3-X4-X5-X6-X7-X8 wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, G, H, I, K, L, M, N, Q, R, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; and X8 is an amino acid selected from A, D, E, F, G, H, I, K, L, M, N, P, Q, R, S, T, V, W and Y.

The following sequence may also be used as a protease cleavage sequence:

(SEQ ID NO: 1067)
X10-X11-X1-X2-X3-X4-X5-X6-X7-X8 wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from E, F, K, M, N, P, Q, R, S and W; X7 is an amino acid selected from A, D, E, F, G, H, I, K, L, M, N, P, Q, R, 5, T, V, W and Y; and X8 is an amino acid selected from A, D, E, F, G, H, I, K, L, M, N, P, Q, R, S, T, V, W and Y.

The following sequence may also be used as a protease cleavage sequence:

(SEQ ID NO: 1068)
X10-X11-X1-X2-X3-X4-X5-X6-X7-X8 wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, F, G, L, M, P, Q, V and W; and X8 is an amino acid selected from A, D, E, F, G, H, I, K, L, M, N, P, Q, R, S, T, V, W and Y.

The following sequence may also be used as a protease cleavage sequence:

(SEQ ID NO: 1069)
X10-X11-X1-X2-X3-X4-X5-X6-X7-X8 wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; and X8 is an amino acid selected from A, D, E, F, G, I, K, N, T and W.

The following sequence may also be used as a protease cleavage sequence:

(SEQ ID NO: 1070)
X10-X11-X1-X2-X3-X4-X5-X6-X7-X8 wherein, X1 to X11 each represent a single amino acid, X10 is an amino acid selected from I, T and Y; X11 is S; X1 is an amino acid selected from A, G, I, P, Q, S and Y; X2 is an amino acid selected from K or T; X3 is G; X4 is R; X5 is S; X6 is A; X7 is an amino acid selected from H, I and V; and X8 is an amino acid selected from H, V and Y.

The following sequence may also be used as a protease cleavage sequence:

(SEQ ID NO: 1071)
X10-X11-X1-X2-X3-X4-X5-X6-X7-X8 wherein, X1 to X11 each represent a single amino acid, X10 is an amino acid selected from I, T and Y; X11 is S; X1 is Y; X2 is an amino acid selected from S and T; X3 is G; X4 is R; X5 is S; X6 is an amino acid selected from A and E; X7 is an amino acid selected from N and V; and X8 is an amino acid selected from H, P, V and Y.

The following sequence may also be used as a protease cleavage sequence:

(SEQ ID NO: 1072)
X10-X11-X1-X2-X3-X4-X5-X6-X7-X8-X9 wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; and X9 is an amino acid selected from A, G, H, I, L and R.

The following sequence may also be used as a protease cleavage sequence:

(SEQ ID NO: 1073)
X10-X11-X1-X2-X3-X4-X5-X6-X7-X8-X9 wherein, X1 to X11 each represent a single amino acid, X10 is an amino acid selected from I, T and Y; X11 is S; X1 is an amino acid selected from A, E, F, G, H, K, M, N, P, Q, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; and X9 is an amino acid selected from A, G, H, I, L and R.

The following sequence may also be used as a protease cleavage sequence:

(SEQ ID NO: 1074)
X10-X11-X1-X2-X3-X4-X5-X6-X7-X8-X9 wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, F, L, M, P, Q, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; and X9 is an amino acid selected from A, G, H, I, L and R.

The following sequence may also be used as a protease cleavage sequence:

(SEQ ID NO: 1075)
X10-X11-X1-X2-X3-X4-X5-X6-X7-X8-X9 wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, E, F, H, I, K, L, M, N, P, Q, R, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; and X9 is an amino acid selected from A, G, H, I, L and R.

The following sequence may also be used as a protease cleavage sequence:

(SEQ ID NO: 1076)
X10-X11-X1-X2-X3-X4-X5-X6-X7-X8-X9 wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, G, H, I, K, L, M, N, Q, R, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; and X9 is an amino acid selected from A, G, H, I, L and R.

The following sequence may also be used as a protease cleavage sequence:

(SEQ ID NO: 1077)
X10-X11-X1-X2-X3-X4-X5-X6-X7-X8-X9 wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from E, F, K, M, N, P, Q, R, S and W; X7 is an amino acid selected from A, D, E, F, G, H, I, K, L, M, N, P, Q, R, S, T, V, W and Y; X8 is an amino acid selected from A, D, E, F, G, H, I, K, L, M, N, P, Q, R, S, T, V, W and Y; and X9 is an amino acid selected from A, G, H, I, L and R.

The following sequence m be used as a protease cleavage sequence:

(SEQ ID NO: 1078)
X10-X11-X1-X2-X3-X4-X5-X6-X7-X8-X9 wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, F, G, L, M, P, Q, V and W; X8 is an amino acid selected from A, D, E, F, G, H, I, K, L, M, N, P, Q, R, S, T, V, W and Y; and X9 is an amino acid selected from A, G, H, I, L and R.

The following sequence may also be used as a protease cleavage sequence:

(SEQ ID NO: 1079)
X10-X11-X1-X2-X3-X4-X5-X6-X7-X8-X9 wherein, X1 to X11 each represent a single amino acid, X10 is an amino acid selected from I, T and Y; X11 is S; X1 is an amino acid selected from A, D, E, F, G, H, I, K, M, N, P, Q, S, T, W and Y; X2 is an amino acid selected from A, D, E, F, H, K, L, M, P, Q, S, T, V, W and Y; X3 is an amino acid selected from A, D, E, F, G, H, I, K, L, M, N, P, Q, R, S, T, V, W and Y; X4 is R; X5 is an amino acid selected from A, D, E, F, G, H, I, K, L, M, N, P, Q, R, S, T, V, W and Y; X6 is an amino acid selected from A, D, E, F, H, I, K, L, M, N, P, Q, R, S, T, V, W and Y; X7 is an amino acid selected from A, D, E, F, G, H, I, K, L, M, N, P, Q, R, S, T, V, W and Y; X8 is an amino acid selected from A, D, E, F, G, I, K, N, T and W; and X9 is an amino acid selected from A, G, H, I, L and R.

The following sequence may also be used as a protease cleavage sequence:

(SEQ ID NO: 1080)
X10-X11-X1-X2-X3-X4-X5-X6-X7-X8-X9 wherein, X1 to X11 each represent a single amino acid, X10 is an amino acid selected from I, T and Y; X11 is S; X1 is an amino acid selected from A, G, I, P, Q, S and Y; X2 is an amino acid selected from K or T; X3 is G; X4 is R; X5 is S; X6 is A; X7 is an amino acid selected from H, I and V; X8 is an amino acid selected from H, V and Y; and X9 is an amino acid selected from A, G, H, I, L and R.

The following sequence may also be used as a protease cleavage sequence:

(SEQ ID NO: 1081)
X10-X11-X1-X2-X3-X4-X5-X6-X7-X8-X9 wherein, X1 to X11 each represent a single amino acid, X10 is an amino acid selected from I, T and Y; X11 is S; X1 is Y; X2 is an amino acid selected from S and T; X3 is G; X4 is R; X5 is S; X6 is an amino acid selected from A and E; X7 is an amino acid selected from N and V; X8 is an amino acid selected from H, P, V and Y; and X9 is an amino acid selected from A, G, H, I, L and R.

In addition to using the above-mentioned protease cleavage sequences, novel protease cleavage sequences may also be obtained by screening. For example, based on the result of crystal structure analysis of a known protease cleavage sequence, novel protease cleavage sequences can be explored by changing the interaction of active residues/recognition residues of the cleavage sequence and the enzyme. Novel protease cleavage sequences can also be explored by altering amino acids in a known protease cleavage sequence and examining interaction between the altered sequence and the protease. As another example, protease cleavage sequences can be explored by examining interaction of the protease with a library of peptides displayed using an in vitro display method such as phage display and ribosome display, or with an array of peptides immobilized onto a chip or beads. Interaction between a protease cleavage sequence and a protease can be examined by testing cleavage of the sequence by the protease in vitro or in vivo.

Cleaved fragments after protease treatment can be separated by electrophoresis such as SDS-PAGE and quantified to evaluate the protease cleavage sequence, the activity of the protease, and the cleavage ratio of a molecule into which the protease cleavage sequence has been introduced. A non-limiting embodiment of the method of evaluating the cleavage ratio of a molecule into which a protease cleavage sequence has been introduced includes the following method: for example, when the cleavage ratio of an antibody variant into which a protease cleavage sequence has been introduced is evaluated using recombinant human u-Plasminogen Activator/Urokinase (human uPA, huPA) (R&D Systems; 1310-SE-010) or recombinant human Matriptase/ST14 Catalytic Domain (human MT-SP1, hMT-SP1) (R&D Systems; 3946-SE-010), 100 g/mL of the antibody variant is reacted with 40 nM huPA or 3 nM hMT-SP1 in PBS at 37° C. for one hour, and then subjected to capillary electrophoresis immunoassay. Capillary electrophoresis immunoassay can be performed using Wes (Protein Simple), but the present method is not limited thereto. As an alternative to capillary electrophoresis immunoassay, SDS-PAGE and such may be performed for separation, followed by detection with Western blotting. The present method is not limited to these methods. Before and after cleavage, the light chain can be detected using anti-human lambda chain HRP-labeled antibody (abcam; ab9007), but any antibody that can detect cleavage fragments may be used. The area of each peak obtained after protease treatment is output using software for Wes (Compass for SW; Protein Simple), and the cleavage ratio (%) of the antibody variant can be determined with the following formula:

(Peak area of cleaved light chain)×100/(Peak area of cleaved light chain+Peak area of uncleaved light chain)

Cleavage ratios can be determined if protein fragments are detectable before and after protease treatment. Cleavage ratios can be determined not only for antibody variants but also for various protein molecules into which a protease cleavage sequence has been introduced.

The in vivo cleavage ratio of a molecule into which a protease cleavage sequence has been introduced can be determined by administering the molecule into animals and detecting the administered molecule in blood samples. For example, an antibody variant into which a protease cleavage sequence has been introduced is administered to mice, and plasma is collected from their blood samples. The antibody is purified from the plasma according to a method known to those skilled in the art using Dynabeads Protein A (Thermo; 10001D), and then subjected to capillary electrophoresis immunoassay to evaluate the protease cleavage ratio of the antibody variant. Capillary electrophoresis immunoassay can be performed using Wes (Protein Simple), but the present method is not limited thereto. As an alternative to capillary electrophoresis immunoassay, SDS-PAGE and such may be performed for separation, followed by detection with Western blotting. The present method is not limited to these methods. The light chain of the antibody variant collected from mice can be detected using anti-human lambda chain HRP-labeled antibody (abeam; ab9007), but any antibody that can detect cleavage fragments may be used. Once the area of each peak obtained by capillary electrophoresis immunoassay is output using software for Wes (Compass for SW; Protein Simple), the ratio of the remaining light chain can be calculated as [Peak area of light chain]/[Peak area of heavy chain] to determine the ratio of the full-length light chain that remain uncleaved in the mouse body. In vivo cleavage efficiencies can be determined if protein fragments collected from a living organism are detectable. Cleavage ratios can be determined not only for antibody variants but also for various protein molecules into which a protease cleavage sequence has been introduced. Calculation of cleavage ratios by the above-mentioned methods enables, for example, comparison of the in vivo cleavage ratios of antibody variants into which different cleavage sequences have been introduced, and comparison of the cleavage ratio of a single antibody variant between different animal models such as a normal mouse model and a tumor-grafted mouse model.

For example, the protease cleavage sequences shown in Table 1 have all been newly discovered by the present inventors. Polypeptides containing these protease cleavage sequences are all useful as protease substrates which are hydrolyzed by the action of proteases. Thus, the present invention provides protease substrates comprising a sequence selected from SEQ ID NOs: 833-852 and 1062-1081, and the sequences listed in Table 1. The protease substrates of the present invention can be utilized as, for example, a library from which one with properties that suit the purpose can be selected to be incorporated into a polypeptide of the present invention. Specifically, in order to cleave the polypeptide of the present invention selectively by a protease localized in the lesion, the substrates can be evaluated for sensitivity to that protease. When a polypeptide of the present invention is administered in vivo, the molecule may come in contact with various proteases before reaching the lesion. Therefore, the molecule should preferably have sensitivity to the protease localized to the lesion and also as high resistance as possible to the other proteases. In order to select a desired protease cleavage sequence depending on the purpose, each protease substrate can be analyzed in advance for sensitivity to various proteases comprehensively to find its protease resistance. Based on the obtained protease resistance spectra, it is possible to find a protease cleavage sequence with necessary sensitivity and resistance.

Alternatively, a polypeptide into which a protease cleavage sequence has been incorporated undergoes not only enzymatic actions by proteases but also various environmental stresses such as pH changes, temperature, and oxidative/reductive stress, before reaching the lesion. Based on the comparative information about resistance to these external factors among the protease substrates, protease cleavage sequence with desired properties can be selected.

In one embodiment of the present invention, a flexible linker is further attached to either one end or both ends of the protease cleavage sequence. The flexible linker at one end of the protease cleavage sequence can be referred to as a first flexible linker, and the flexible linker at the other end can be referred to as a second flexible linker. In a particular embodiment, the protease cleavage sequence and the flexible linker have any of the following formulas:
(protease cleavage sequence),
(first flexible linker)-(protease cleavage sequence),
(protease cleavage sequence)-(second flexible linker), and
(first flexible linker)-(protease cleavage sequence)-(second flexible linker).

The flexible linker according to the present embodiment is preferably a peptide linker. The first flexible linker and the second flexible linker each independently and arbitrarily exist and are identical or different flexible linkers each containing at least one flexible amino acid (Gly, etc.). The flexible linker contains, for example, a sufficient number of residues (amino acids arbitrarily selected from Arg, Ile, Gin, Glu, Cys, Tyr, Trp, Thr, Val, His, Phe, Pro, Met, Lys, Gly, Ser, Asp, Asn, Ala, etc., particularly Gly, Ser, Asp, Asn, and Ala, in particular, Gly and Ser, especially Gly, etc.) for the protease cleavage sequence to obtain the desired protease accessibility.

The flexible linker suitable for use at both ends of the protease cleavage sequence is usually a flexible linker that improves the access of protease to the protease cleavage sequence and elevates the cleavage efficiency of the protease. A suitable flexible linker may be readily selected and can be preferably selected from among different lengths such as 1 amino acid (Gly, etc.) to 20 amino acids, 2 amino acids to 15 amino acids, or 3 amino acids to 12 amino acids including 4 amino acids to 10 amino acids, 5 amino acids to 9 amino acids, 6 amino acids to 8 amino acids, or 7 amino acids to 8 amino acids. In some embodiments of the present invention, the flexible linker is a peptide linker of 1 to 7 amino acids.

Examples of the flexible linker include, but are not limited to, glycine polymers (G)n, glycine-serine polymers (including e.g., (GS)n, (GSGGS: SEQ ID NO: 27)n and (GGGS: SEQ ID NO: 28)n, wherein n is an integer of at least 1), glycine-alanine polymers, alanine-serine polymers, and other flexible linkers well known in conventional techniques. Among them, glycine polymers and glycine-serine polymers are receiving attention because these amino acids are relatively unstructured and easily function as neutral tethers between components.

Examples of the flexible linker consisting of the glycine-serine polymer include, but are not limited to,

```
Ser

Gly·Ser (GS)

Ser·Gly (SG)

Gly·Gly·Ser (GGS)

Gly·Ser·Gly (GSG)

Ser·Gly·Gly (SGG)

Gly·Ser·Ser (GSS)

Ser·Ser·Gly (SSG)

Ser·Gly·Ser (SGS)

(GGGS, SEQ ID NO: 28)
Gly·Gly·Gly·Ser (GGSG, SEQ ID NO: 29)
Gly·Gly·Ser·Gly (GSGG, SEQ ID NO: 46)
Gly·Ser·Gly·Gly (SGGG, SEQ ID NO: 47)
Ser·Gly·Gly·Gly (GSSG, SEQ ID NO: 48)
Gly·Ser·Ser·Gly (GGGGS, SEQ ID NO: 49)
Gly·Gly·Gly·Gly·Ser (GGGSG, SEQ ID NO: 33)
Gly·Gly·Gly·Ser·Gly (GGSGG, SEQ ID NO: 30)
Gly·Gly·Ser·Gly·Gly (GSGGG, SEQ ID NO: 32)
Gly·Ser·Gly·Gly·Gly (GSGGS, SEQ ID NO: 27)
Gly·Ser·Gly·Gly·Ser (SGGGG, SEQ ID NO: 51)
Ser·Gly·Gly·Gly·Gly (GSSGG, SEQ ID NO: 52)
Gly·Ser·Ser·Gly·Gly (GSGSG, SEQ ID NO: 31)
Gly·Ser·Gly·Ser·Gly (SGGSG, SEQ ID NO: 53)
Ser·Gly·Gly·Ser·Gly (GSSSG, SEQ ID NO: 34)
Gly·Ser·Ser·Ser·Gly (GGGGGS, SEQ ID NO: 50)
Gly·Gly·Gly·Gly·Gly·Ser (SGGGGG, SEQ ID NO: 54)
Ser·Gly·Gly·Gly·Gly·Gly (GGGGGGS, SEQ ID NO: 55)
Gly·Gly·Gly·Gly·Gly·Gly·Ser (SGGGGGG, SEQ ID NO: 56)
Ser·Gly·Gly·Gly·Gly·Gly·Gly (GGGGS, SEQ ID NO: 49))n
(Gly·Gly·Gly·Gly·Ser (SGGGG, SEQ ID NO: 51))n
(Ser·Gly·Gly·Gly·Gly.
```

In the present specification, the "association" can refer to, for example, a state where two or more polypeptide regions interact with each other. In general, a hydrophobic bond, a hydrogen bond, an ionic bond, or the like is formed between the intended polypeptide regions to form an association product. As one example of common association, an antibody typified by a native antibody is known to retain a paired structure of a heavy chain variable region (VH) and a light chain variable region (VL) through a noncovalent bond or the like therebetween.

In some embodiments of the present invention, the inhibiting domain of the carrying moiety is associated with the antigen-binding domain. The inhibiting domain may constitute a portion of the carrying moiety or may constitute the whole of the carrying moiety. From another viewpoint, the inhibiting domain can also be defined as a moiety being associated with the antigen-binding domain, in the carrying moiety. In a more specific embodiment, the antigen-binding domain which is a single-domain antibody and the inhibiting domain which is VL, VH or VHH form association as found between antibody VH and antibody VL. In a further specific embodiment, the antigen-binding domain which is a single-domain antibody and the inhibiting domain which is VL, VH or VHH form association as found between antibody VH and antibody VL, and in a state of the association thus formed, the inhibiting domain conformationally inhibits the binding of the antigen-binding domain to the antigen or conformationally changes the antigen-binding site of the antigen-binding domain so that the antigen-binding activity of the single-domain antibody is inhibited by the VL, the VH or the VHH. In an embodiment using VHH as the single-domain antibody, it is considered that the binding of the VHH to the antigen is conformationally inhibited by the inhibiting domain when CDR3, a main antigen-binding site of the VHH, or its neighboring site exists at the interface of association with the inhibiting domain.

The association of the antigen-binding domain with the inhibiting domain may be canceled, for example, by cleaving the cleavage site. The cancelation of the association can be used interchangeably with, for example, the cancelation of the state where two or more polypeptide regions interact with each other. The interaction between the two or more polypeptide regions may be wholly canceled, or the interaction between the two or more polypeptide regions may be partially canceled.

In the present specification, the "interface" usually refers to a face at which two regions associate or interact with each other. Amino acid residues forming the interface are usually one or a plurality of amino acid residues contained in each polypeptide region subjected to the association and more preferably refer to amino acid residues that approach each other upon association and participate in interaction. Specifically, the interaction includes noncovalent bonds such as a hydrogen bond, electrostatic interaction, or salt bridge formation between the amino acid residues approaching each other upon association.

In the present specification, the "amino acid residues forming the interface" specifically refers to amino acid residues contained in polypeptide regions constituting the interface. As one example, the polypeptide regions constituting the interface refer to polypeptide regions responsible for intramolecular or intermolecular selective binding in antibodies, ligands, receptors, substrates, etc. Specific examples of such polypeptide regions in antibodies can include heavy chain variable regions and light chain variable regions. In some embodiments of the present invention, examples of such polypeptide regions can include antigen-binding domains and inhibiting domains.

Examples of the amino acid residues forming the interface include, but are not limited to, amino acid residues approaching each other upon association. The amino acid residues approaching each other upon association can be found, for example, by analyzing the conformations of polypeptides and examining the amino acid sequences of polypeptide regions forming the interface upon association of the polypeptides.

In some embodiments of the present invention, an amino acid residue(s) involved in association in the antigen-binding domain, or an amino acid residue(s) involved in association in the inhibiting domain can be altered in order to promote the association of the antigen-binding domain with the inhibiting domain. In a further specific embodiment, an amino acid residue(s) forming the interface with the inhibiting domain, in the antigen-binding domain, or an amino acid residue(s) forming the interface with the antigen-binding domain, in the inhibiting domain can be altered. In a preferred embodiment, the amino acid residue(s) forming the interface can be altered by a method of introducing a mutation(s) to the interface amino acid residue(s) such that two or more amino acid residues forming the interface have different charges. The alteration of the amino acid residue(s) to result in different charges includes the alteration of a positively charged amino acid residue(s) to a negatively charged amino acid residue(s) or an uncharged amino acid residue, the alteration of a negatively charged amino acid residue to a positively charged amino acid residue(s) or an uncharged amino acid residue(s), and the alteration of an uncharged amino acid residue(s) to a positively or negatively charged amino acid residue(s). Such an amino acid alteration is performed for the purpose of promoting the association and is not limited by the position of the amino acid alteration or the type of the amino acid as long as the purpose of promoting the association can be achieved. Examples of the alteration include, but are not limited to, substitution.

In some embodiments of the present invention, VHH serving as the antigen-binding domain is associated with VL serving as the inhibiting domain. The amino acid residue involved in association with VL, in VHH can refer to, for example, an amino acid residue forming the interface between the VHH and the VL. Examples of the amino acid residue involved in association with VL, in VHH include, but are not limited to, amino acid residues at positions 37, 44, 45, and 47 (J. Mol. Biol. (2005) 350, 112-125). The activity of the VHH is inhibited by promoting the association between the VHH and the VL. Likewise, the amino acid residue involved in association with VHH, in VL can refer to, for example, an amino acid residue forming the interface between the VHH and the VL.

An amino acid residue involved in the association with VL, in VHH can be altered in order to promote the association between the VHH and the VL. Examples of such an amino acid substitution include, but are not limited to, F37V, Y37V, E44G, Q44G, R45L, H45L, G47W, F47W, L47W, T47W, or/and S47W. Instead of altering each residue in VHH, VHH originally having an amino acid residue 37V, 44G, 45L, or/and 47W may also be used. Instead of the VHH amino acid, an amino acid residue involved in association with VHH, in VL may be altered, and amino acid alterations may also be introduced to both VHH and VL, as long as the purpose of promoting the association between the VHH and the VL can be achieved.

In some alternative embodiments of the present invention, the antigen-binding domain and the inhibiting domain can be associated with each other by using VHH as the antigen-binding domain and using VH or VHH as the inhibiting domain. An amino acid residue involved in association with VH or VHH serving as the inhibiting domain, in VHH serving as the antigen-binding domain can be identified and altered in order to promote the association of the antigen-binding domain VHH with the inhibiting domain VH or VHH. Also, amino acid residues involved in association with VHH serving as the antigen-binding domain, in VH or VHH serving as the inhibiting domain, can be identified and altered.

In the case of using a single-domain antibody other than VHH as the antigen-binding domain, amino acid residues involved in association, in the antigen-binding domain or the inhibiting domain can also be identified and altered similarly to above.

In some embodiments of the present invention, the carrying moiety and the antigen-binding domain are fused via a linker. In a more specific embodiment, the carrying moiety and the antigen-binding domain are fused via a linker containing a cleavage site. In an alternative specific embodiment, the carrying moiety and the antigen-binding domain are fused via a linker, and the fusion protein thus formed contains a cleavage site.

In another embodiment of the present invention, the carrying moiety and the antigen-binding domain are fused without a linker. In a more specific embodiment, an amino bond is formed between the N-terminal amino acid of the carrying moiety and the C-terminal amino acid of the antigen-binding domain to form a fusion protein. The formed fusion protein contains a cleavage site. In a particular embodiment, one to several N-terminal amino acids of the carrying moiety or/and one to several C-terminal amino acids of the antigen-binding domain are altered, and the N terminus of the carrying moiety and the C terminus of the antigen-binding domain are fused to form a cleavage site near the fusion position. More specifically, the cleavage site can be formed, for example, by converting four C-terminal amino acids of the antigen-binding domain to an LSGR (SEQ ID NO:1089) sequence and converting four N-terminal amino acids of the carrying moiety to an SDNH (SEQ ID NO: 1090) sequence.

In some embodiments of the present invention, the cleavage site of the polypeptide comprising a carrying moiety and an antigen-binding domain comprises a protease cleavage sequence. The protease cleavage sequence may be placed at any position in the polypeptide as long as the antigen-binding domain is released by protease cleavage and does not lose its antigen-binding activity after the release.

In some embodiments of the present invention, the carrying moiety comprises an antibody constant region, and the N terminus of the antibody constant region and the C terminus of the antigen-binding domain are fused via a linker or without a linker. In a particular embodiment, the protease cleavage sequence is located within the antibody constant region contained in the carrying moiety. In this case, the protease cleavage sequence can be located within the antibody constant region such that the antigen-binding domain is released by protease cleavage. In a specific embodiment, the protease cleavage sequence is located within an antibody heavy chain constant region contained in the carrying moiety, and more specifically located in the antibody heavy chain constant region on the side closer to the antigen-binding domain beyond the amino acid of position 140 (EU numbering), preferably in the antibody heavy chain constant region on the side closer to the antigen-binding domain beyond the amino acid of position 122 (EU numbering). In an alternative specific embodiment, the protease cleavage sequence is located within an antibody light chain constant region contained in the carrying moiety, and more specifically located in the antibody light chain constant region on the side closer to the antigen-binding domain beyond the amino acid of position 130 (EU numbering) (Kabat numbering position 130), preferably in the antibody light chain constant region on the side closer to the antigen-binding domain beyond the amino acid of position 113 (EU numbering) (Kabat numbering position 113).

In some embodiments of the present invention, the antigen-binding domain is a single-domain antibody, and the C terminus of the single-domain antibody and the N terminus of the carrying moiety are fused via a linker or without a linker.

In a particular embodiment, the protease cleavage sequence is located within the single-domain antibody. In a more specific embodiment, the single-domain antibody is a single-domain antibody prepared from VH, or from VHH, and the protease cleavage sequence is located in the single-domain antibody on the side closer to the carrying moiety beyond the amino acid of position 35b (Kabat numbering), preferably in the single-domain antibody on the side closer to the carrying moiety beyond the amino acid of position 95 (Kabat numbering), more preferably in the single-domain antibody on the side closer to the carrying moiety beyond the amino acid of position 109 (Kabat numbering). In an alternative specific embodiment, the single-domain antibody is a single-domain antibody prepared from VL, and the protease cleavage sequence is located in the single-domain antibody on the side closer to the carrying moiety beyond the amino acid of position 32 (Kabat numbering), preferably in the single-domain antibody on the side closer to the carrying moiety beyond the amino acid of position 91 (Kabat numbering), more preferably in the single-domain antibody on the side closer to the carrying moiety beyond the amino acid of position 104 (Kabat numbering).

In some embodiments of the present invention, the carrying moiety comprises an antibody constant region, the antigen-binding domain is a single-domain antibody, and the antibody constant region and the single-domain antibody are fused via a linker or without a linker. In a more specific embodiment, the N terminus of the antibody constant region and the C terminus of the single-domain antibody are fused via a linker or without a linker. In an alternative specific embodiment, the C terminus of the antibody constant region and the N terminus of the single-domain antibody are fused via a linker or without a linker.

In a particular embodiment, the protease cleavage sequence is located within the antibody constant region contained in the carrying moiety. In a more specific embodiment, the protease cleavage sequence is located in an antibody heavy chain constant region on the side closer to the single-domain antibody beyond the amino acid of position 140 (EU numbering), preferably in an antibody heavy chain constant region on the side closer to the single-domain antibody beyond the amino acid of position 122 (EU numbering). In an alternative specific embodiment, the protease cleavage sequence is located in an antibody light chain constant region on the side closer to the antigen-binding domain beyond the amino acid of position 130 (EU numbering) (Kabat numbering position 130), preferably in an antibody light chain constant region on the side closer to the antigen-binding domain beyond the amino acid of position 113 (EU numbering) (Kabat numbering position 113).

In a particular embodiment, the protease cleavage sequence is located within the single-domain antibody. In a more specific embodiment, the single-domain antibody is a single-domain antibody prepared from VH, or from VHH, and the protease cleavage sequence is located in the single-domain antibody on the side closer to the antibody constant region beyond the amino acid of position 35b (Kabat numbering), preferably in the single-domain antibody on the side closer to the antibody constant region beyond the amino acid of position 95 (Kabat numbering), more preferably in the single-domain antibody on the side closer to the antibody constant region beyond the amino acid of position 109 (Kabat numbering). In an alternative specific embodiment, the single-domain antibody is a single-domain antibody prepared from VL, and the protease cleavage sequence is located in the single-domain antibody on the side closer to the antibody constant region beyond the amino acid of position 32 (Kabat numbering), preferably in the single-domain antibody on the side closer to the antibody constant region beyond the amino acid of position 91 (Kabat numbering), more preferably in the single-domain antibody on the side closer to the antibody constant region beyond the amino acid of position 104 (Kabat numbering).

In a particular embodiment, the protease cleavage sequence is located near the boundary between the antigen-binding domain and the carrying moiety. The phrase "near the boundary between the antigen-binding domain and the carrying moiety" refers to a moiety that resides upstream or downstream of the linking site between the antigen-binding domain and the carrying moiety and does not largely influence the secondary structure of the antigen-binding domain.

In a more specific embodiment, the antigen-binding domain is linked to the antibody constant region contained in the carrying moiety, and the protease cleavage sequence is located near the boundary between the antigen-binding domain and the antibody constant region. The phrase "near the boundary between the antigen-binding domain and the antibody constant region" can refer to near the boundary between the antigen-binding domain and an antibody heavy chain constant region, or near the boundary between the antigen-binding domain and an antibody light chain constant region. When the antigen-binding domain is a single-domain antibody prepared from VH, or from VHH and is connected to an antibody heavy chain constant region, the phrase "near the boundary between the antigen-binding domain and the antibody constant region" can refer to between the amino acid of position 101 (Kabat numbering) of the single-domain antibody and the amino acid of position 140 (EU numbering) of the antibody heavy chain constant region and can preferably refer to between the amino acid of position 109 (Kabat numbering) of the single-domain antibody and the amino acid of position 122 (EU numbering) of the antibody heavy chain constant region. When the antigen-binding domain is a single-domain antibody prepared from VH, or from VHH and is connected to an antibody light chain constant region, the phrase "near the boundary between the antigen-binding domain and the antibody light chain constant region" can refer to between the amino acid of position 101 (Kabat numbering) of the single-domain antibody and the amino acid of position 130 (EU numbering) (Kabat numbering position 130) of the antibody light chain constant region and can preferably refer to between the amino acid of position 109 (Kabat numbering) of the single-domain antibody and the amino acid of position 113 (EU numbering) (Kabat numbering position 113) of the antibody light chain constant region. When the antigen-binding domain is a single-domain antibody prepared from VL, the phrase "near the boundary between the antigen-binding domain and the antibody constant region" refers to between the amino acid of position 96 (Kabat numbering) of the single-domain antibody and the prescribed position of the antibody constant region, preferably between the amino acid of position 104 (Kabat numbering) of the single-domain antibody and the prescribed position of the antibody constant region.

In some embodiments of the present invention, the polypeptide is an IgG antibody-like molecule. Examples of such embodiments include, but are not limited to: an embodiment in which the carrying moiety comprises an IgG antibody constant region, a single-domain antibody serving as the antigen-binding domain takes the place of VH of an IgG antibody, and the antigen-binding activity is inhibited by a VL; an embodiment in which the carrying moiety comprises an IgG antibody constant region, a single-domain antibody serving as the antigen-binding domain takes the place of VL of an IgG antibody, and the antigen-binding activity is inhibited by VH; and an embodiment in which the carrying moiety comprises an IgG antibody constant region, a single-domain antibody serving as the antigen-binding domain takes the place of one of VH and VL of an IgG antibody, and an additional single-domain antibody inhibits the antigen-binding activity of the antigen-binding domain takes the place of the other domain of the IgG antibody.

The term "IgG antibody-like molecule" used in the present specification is used to define a molecule having moieties substantially similar in structure to constant domains or constant regions as in an IgG antibody, and moieties substantially similar in structure to variable domains or variable regions as in the IgG antibody, and having conformation substantially similar to that of the IgG antibody. In the IgG antibody-like molecule, the domain similar to antibody CH1 and the domain similar to CL may be used interchangeably; that is, as long as interaction similar to the interaction between CH1 and CL of an IgG antibody is present between the domains, the domains linked to the portion similar to the antibody hinge region may be an antibody CH1 domain or an antibody CL domain. However, in the present specification, the "IgG antibody-like molecule" may or may not exert antigen-binding activity while retaining the structures similar to those of the IgG antibody.

The polypeptide may comprise one or a plurality of antigen-binding domains. One or a plurality of inhibiting domains may inhibit the antigen-binding activity of a plurality of antigen-binding domains. A plurality of antigen-binding domains may each be associated with the inhibiting domain. A plurality of antigen-binding domains may each be fused with the carrying moiety. A plurality of antigen-binding domains may each be capable of being released from the polypeptide. The cleavage site(s) for release of a plurality of antigen-binding domains may be a plurality of cleavage sites corresponding to the number of antigen-binding domains.

Figure 7:
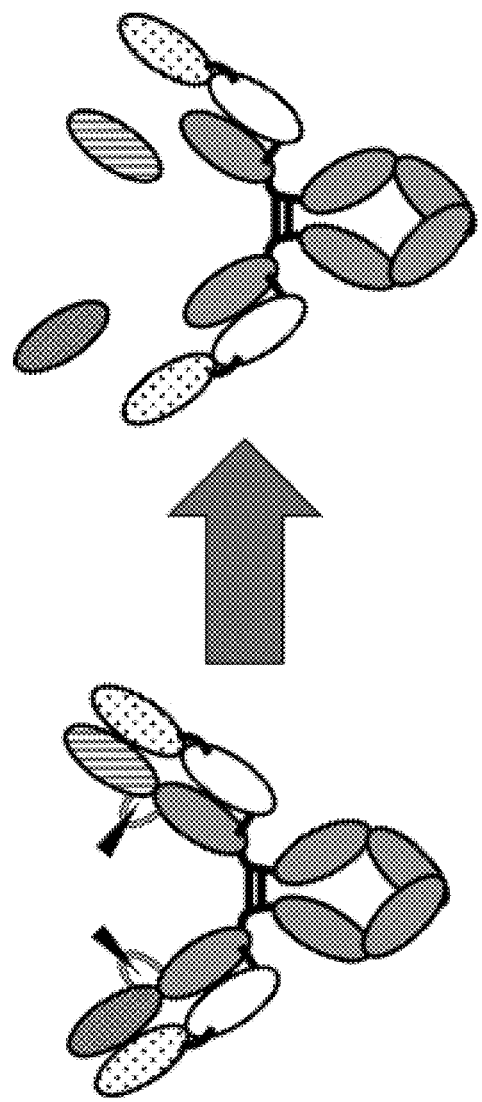
FIG. 7 is a diagram showing one embodiment of the polypeptide of the present invention. In the present embodiment, the polypeptide is an IgG antibody-like molecule, and antigen-binding domains are respectively established at moieties corresponding to two variable regions of the IgG antibody. The two antigen-binding domains may have the same antigen-binding specificity or may differ in antigen-binding specificity.

When the polypeptide is an IgG antibody-like molecule, antigen-binding domains may be respectively established at moieties corresponding to two variable regions of the IgG antibody, as shown in FIG. 7. Such an embodiment should be understandable by those skilled in the art with reference to the present invention. The antigen-binding domains incorporated in both arms may have the same antigen-binding specificity or may differ in antigen-binding specificities. Such an embodiment should be understandable by those skilled in the art with reference to the present invention. It is obvious that these embodiments are included in the scope of the present invention.

In some embodiments of the present invention, the antigen-binding domain is further linked to a second antigen-binding domain. Examples of the second antigen-binding domain include, but are not limited to, single-domain antibodies, antibody fragments, a module called A domain of approximately 35 amino acids contained in an in vivo cell membrane protein avimer (WO2004/044011 and WO2005/040229), adnectin containing a 10Fn3 domain serving as a protein binding domain derived from a glycoprotein fibronectin expressed on cell membranes (WO2002/032925), Affibody containing an IgG binding domain scaffold constituting a three-helix bundle composed of 58 amino acids of protein A (WO1995/001937), DARPins (designed ankyrin repeat proteins) which are molecular surface-exposed regions of ankyrin repeats (AR) each having a 33-amino acid residue structure folded into a subunit of a turn, two antiparallel helices, and a loop (WO2002/020565), anticalin having four loop regions connecting eight antiparallel strands bent toward the central axis in one end of a barrel structure highly conserved in lipocalin molecules such as neutrophil gelatinase-associated lipocalin (NGAL) (WO2003/029462), and a depressed region in the internal parallel sheet structure of a horseshoe-shaped fold composed of repeated leucine-rich-repeat (LRR) modules of an immunoglobulin structure-free variable lymphocyte receptor (VLR) as seen in the acquired immune systems of jawless vertebrates such as lamprey or hagfish (WO2008/016854). In a preferred embodiment, the second antigen-binding domain has antigen-binding specificity different from that of the antigen-binding domain. In a preferred embodiment, the molecular weight of the antigen-binding domain and the second antigen-binding domain linked is 60 kDa or smaller. In some more specific embodiments, the antigen-binding domain and the second antigen-binding domain are single-domain antibodies differing in antigen-binding specificities, the antigen-binding domain and the second antigen-binding domain linked are capable of being released from the polypeptide, and the antigen-binding domain and the second antigen-binding domain form a bispecific antigen-binding molecule after release. Examples of such a bispecific antigen-binding molecule include, but are not limited to, a bispecific antigen-binding molecule having an antigen-binding domain specifically binding to the target cell surface antigen and a second antigen-binding domain specifically binding to an immunocyte surface antigen, a bispecific antigen-binding molecule having an antigen-binding domain and a second antigen-binding domain binding to different subunits of the same antigen, and a bispecific antigen-binding molecule having an antigen-binding domain and a second antigen-binding domain binding to different epitopes in the same antigen. Such a bispecific antigen-binding molecule can recruit immunocytes to the vicinity of target cells and is thus considered useful in the treatment of a disease caused by the target cells.

The antigen-binding activity of the second antigen-binding domain may or may not be inhibited by the carrying moiety. The second antigen-binding domain may or may not be associated with a partial structure of the carrying moiety. Particularly, when the antigen-binding domain and the second antigen-binding domain differ in antigen-binding specificities, the antigen-binding domain in an unreleased state cannot exert antigen-binding activity, as shown in, for example, FIG. 8, even if the antigen-binding activity of the second antigen-binding domain is not inhibited and even if the second antigen-binding domain is not associated with a partial structure of the carrying moiety. This bispecific antigen-binding molecule comprising the antigen-binding domain linked to the second antigen-binding domain cannot exert a function of bispecifically binding to two types of antigens.

Figure 8:
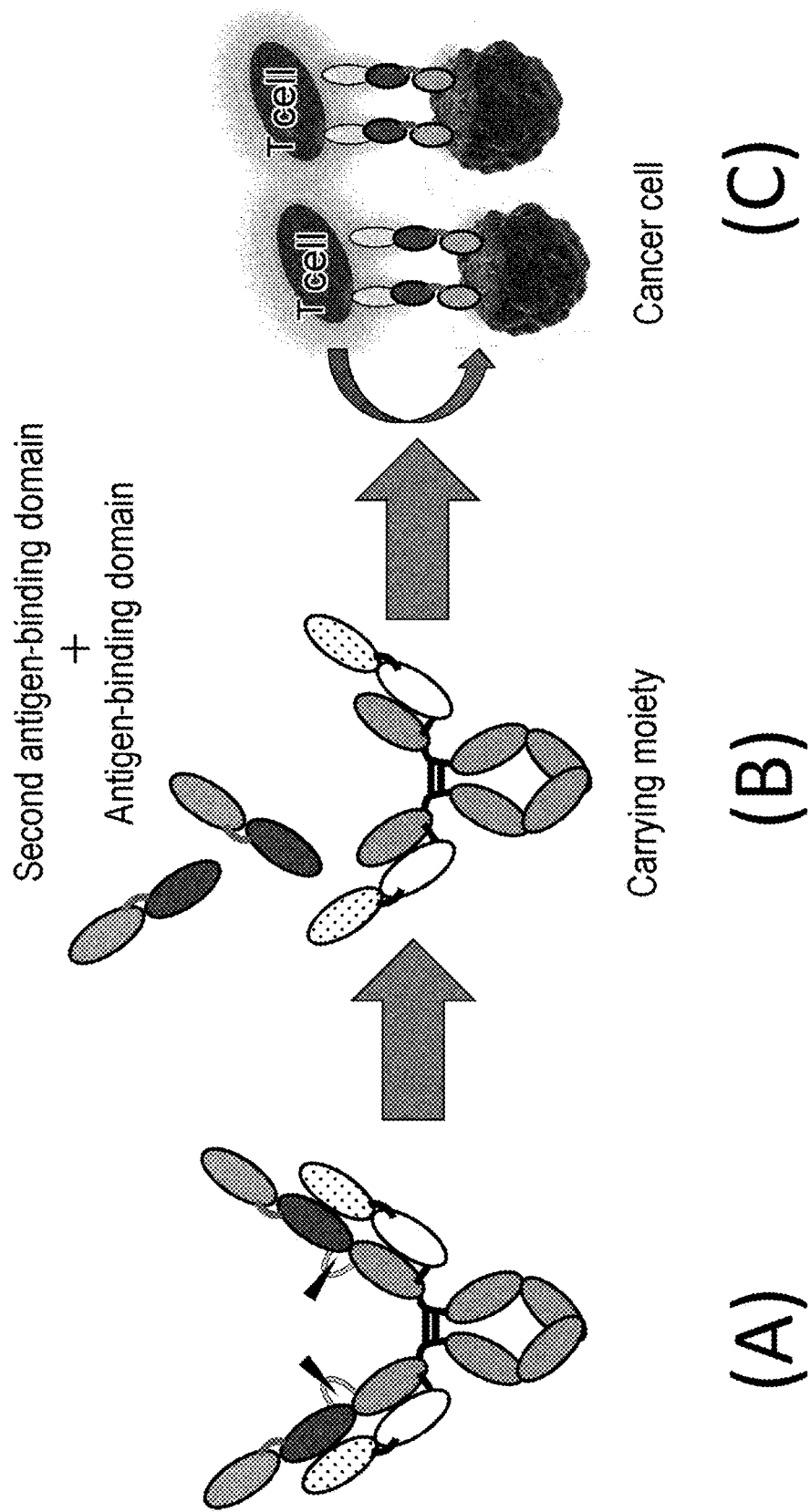
FIG. 8 is a diagram showing an embodiment in which a second antigen-binding domain is further linked to the antigen-binding domain of the present invention. In this embodiment, the antigen-binding domain and the second antigen-binding domain form a bispecific antigen-binding molecule after release.

FIG. 8 shows one exemplary form in which the antigen-binding domain is further linked to the second antigen-binding domain.

In the present specification, the term "specificity" refers to a property by which one of specifically binding molecules does not substantially bind to a molecule other than its one or more binding partner molecules. This term is also used when the antigen-binding domain has specificity for an epitope contained in a particular antigen. The term is also used when the antigen-binding domain has specificity for a particular epitope among a plurality of epitopes contained in an antigen. In this context, the term "not substantially bind" is determined according to the method described in the section about binding activity and means that the binding activity of a specific binding molecule for a molecule other than the binding partner(s) is 80% or less, usually 50% or less, preferably 30% or less, particularly preferably 15% or less, of its binding activity for the binding partner molecule(s).

The present invention also relates to a pharmaceutical compositions (drugs) comprising the polypeptide of the present invention and a pharmaceutically acceptable carrier.

The "treatment" (and its grammatically derived words, for example, "treat" and "treating") used in the present specification means clinical intervention that intends to alter the natural course of an individual to be treated and can be carried out both for prevention and during the course of a clinical pathological condition. The desirable effect of the treatment includes, but is not limited to, the prevention of the development or recurrence of a disease, the alleviation of symptoms, the attenuation of any direct or indirect pathological influence of the disease, the prevention of metastasis, reduction in the rate of progression of the disease, recovery from or alleviation of a disease condition, and ameliorated or improved prognosis. In some embodiments, the polypeptide of the present invention is used for delaying the onset of a disease(s) or delaying the progression of the disease(s).

In the present invention, the pharmaceutical composition usually refers to a drug for the treatment or prevention of a disease or for examination or diagnosis. In the present invention, the term "pharmaceutical composition comprising the polypeptide" may be used interchangeably with a "method for treating a disease, comprising administering the polypeptide to a subject to be treated" and may be used interchangeably with "use of the polypeptide for the production of a drug for the treatment of a disease". Also, the term "pharmaceutical composition comprising the polypeptide" may be used interchangeably with "use of the polypeptide for treating a disease".

The pharmaceutical compositions of the present invention can be formulated by use of a method known to those skilled in the art. For example, the pharmaceutical compositions can be parenterally used in an injection form of a sterile solution or suspension with water or any of other pharmaceutically acceptable liquids. The pharmaceutical compositions can be formulated, for example, by appropriately combining the polypeptide with a pharmacologically acceptable carrier or medium, specifically, sterile water or physiological saline, a plant oil, an emulsifier, a suspending agent, a surfactant, a stabilizer, a flavoring agent, an excipient, a vehicle, an antiseptic, a binder, etc. and mixing them into a unit dosage form required for generally accepted pharmaceutical practice. The amount of the active ingredient in these formulations is set so as to give an appropriate volume in a prescribed range.

A sterile composition for injection can be formulated according to usual pharmaceutical practice using a vehicle such as injectable distilled water. Examples of the injectable aqueous solution include isotonic solutions containing physiological saline, glucose, or other adjuvants (e.g., D-sorbitol, D-mannose, D-mannitol, and sodium chloride). The aqueous solution can be used in combination with an appropriate solubilizer, for example, an alcohol (ethanol, etc.), a polyalcohol (propylene glycol, polyethylene glycol, etc.), or a nonionic surfactant (Polysorbate 80™, HCO-50, etc.).

Examples of the oil solution include sesame oil and soybean oil. The oil solution can also be used in combination with benzyl benzoate and/or benzyl alcohol as a solubilizer. The oil solution can be supplemented with a buffer (e.g., a phosphate buffer solution and a sodium acetate buffer solution), a soothing agent (e.g., procaine hydrochloride), a stabilizer (e.g., benzyl alcohol and phenol), and an antioxidant. The prepared injection solution is usually filled into an appropriate ampule.

The pharmaceutical composition of the present invention is preferably administered through a parenteral route. For example, a composition having an injection, transnasal, transpulmonary, or percutaneous dosage form is administered. The pharmaceutical composition can be administered systemically or locally by, for example, intravenous injection, intramuscular injection, intraperitoneal injection, or subcutaneous injection.

The administration method can be appropriately selected according to the age and symptoms of a patient. The dose of the pharmaceutical composition containing the polypeptide can be set to the range of, for example, 0.0001 mg to 1000 mg per kg body weight per dose. Alternatively, the dose of the pharmaceutical composition containing the polypeptide can be set to a dose of, for example, 0.001 mg to 100000 mg per patient. However, the present invention is not necessarily limited by these numerical values. Although the dose and the administration method vary depending on the body weight, age, symptoms, etc. of a patient, those skilled in the art can set an appropriate dose and administration method in consideration of these conditions.

The present invention also relates to methods for producing a polypeptide comprising a carrying moiety having an inhibiting domain, and an antigen-binding domain.

One method for producing the polypeptide of the present invention is a method comprising: obtaining an antigen-binding domain having antigen-binding activity; linking the antigen-binding domain to a carrying moiety such that the antigen-binding activity of the antigen-binding domain is inhibited by an inhibiting domain, to form a polypeptide precursor; and further inserting a cleavage site into the polypeptide precursor or altering a portion of the polypeptide precursor to a cleavage site. The method for introducing the cleavage site can be any of the insertion of the cleavage site and the alteration of a portion of the polypeptide precursor as long as the cleavage site can be introduced into the polypeptide precursor. Alternatively, an alteration site may be introduced into the polypeptide precursor by the combination of both the approaches. Such an embodiment should be obvious to those skilled in the art with reference to the present specification and is included in the scope of the present invention.

Another method for producing the polypeptide of the present invention is a method comprising: obtaining an antigen-binding domain having antigen-binding activity; and linking the antigen-binding domain to a carrying moiety via a cleavage site such that the antigen-binding activity of the antigen-binding domain is inhibited by an inhibiting domain, to form a polypeptide. When the antigen-binding domain is linked to the carrying moiety via a cleavage site, the cleavage site may be sandwiched between the antigen-binding domain and the carrying moiety, or a portion of the antigen-binding domain or/and a portion of the carrying moiety may be altered and used as a portion of the cleavage site.

To "insert" amino acid sequence A into amino acid sequence B refers to splitting amino acid sequence B into two parts without deletion, and linking the two parts with amino acid sequence A (that is, producing such an amino acid sequence as "first half of amino acid sequence B—amino acid sequence A—second half of amino acid sequence B"). To "introduce" amino acid sequence A into amino acid sequence B refers to splitting amino acid sequence B into two parts and linking the two parts with amino acid sequence A. This encompasses not only "inserting" amino acid sequence A into amino acid sequence B as mentioned above, but also linking the two parts with amino acid sequence A after deleting one or a plurality of amino acid residues of amino acid sequence B including those adjacent to amino acid sequence A (that is, replacing a portion of amino acid sequence B with amino acid sequence A).

In an embodiment using a single-domain antibody as the antigen-binding domain and using a protease cleavage sequence as the cleavage site, the methods for producing the polypeptide will be described below.

In one embodiment of the present invention, the method for producing a polypeptide comprising a carrying moiety having an inhibiting domain, and an antigen-binding domain is a production method comprising the following steps:
(a) obtaining a single-domain antibody binding to a target antigen;
(b) linking the single-domain antibody obtained in the step (a) to a carrying moiety such that the antigen-binding activity of the single-domain antibody is inhibited by an inhibiting domain of the carrying moiety, to form a polypeptide precursor; and
(c) introducing a protease cleavage sequence into the polypeptide precursor.

In one embodiment of the present invention, the method for producing a polypeptide comprising a carrying moiety having an inhibiting domain, and an antigen-binding domain is a production method comprising the following steps:
(a) obtaining a single-domain antibody binding to a target antigen;
(b) linking the single-domain antibody obtained in the step (a) to a carrying moiety such that the antigen-binding activity of the single-domain antibody is inhibited by an inhibiting domain of the carrying moiety, to form a polypeptide precursor; and
(c) introducing a protease cleavage sequence to near the boundary between the single-domain antibody and the carrying moiety.

In one embodiment of the present invention, the method for producing a polypeptide comprising a carrying moiety having an inhibiting domain, and an antigen-binding domain is a production method comprising the following steps:
(a) obtaining a single-domain antibody binding to a target antigen; and
(b) linking the single-domain antibody obtained in the step (a) to the carrying moiety via a protease cleavage sequence such that the antigen-binding activity of the single-domain antibody is inhibited by an inhibiting domain of the carrying moiety, to form a polypeptide.

In a particular embodiment, the method for producing a polypeptide comprising a carrying moiety having an inhibiting domain, and an antigen-binding domain is the production method further comprising the following step:
(d) confirming that the binding activity of the single-domain antibody incorporated into the polypeptide or into the polypeptide precursor against the target antigen is weakened or lost.

In the present invention, the phrase "binding activity is weakened" means that the binding activity against the target antigen is decreased as compared with that before the linking, and the degree of this decrease is not limited.

In a particular embodiment, the method for producing a polypeptide comprising a carrying moiety having an inhibiting domain, and an antigen-binding domain is the production method further comprising the following step:
(e) releasing the single-domain antibody by the protease cleavage of the protease cleavage sequence and confirming that the released single-domain antibody binds to the antigen.

In one embodiment of the present invention, the method for producing a polypeptide which is an IgG antibody-like molecule comprising a carrying moiety having an inhibiting domain, and an antigen-binding domain is a production method comprising the following steps:
(a) obtaining a single-domain antibody binding to a target antigen;
(b) allowing the single-domain antibody obtained in the step (a) to be associated with a VL as a substitute for VH of an IgG antibody, or allowing the single-domain antibody to be associated with a VH as a substitute for VL of an IgG antibody such that the antigen-binding activity of the single-domain antibody is inhibited, to form an IgG antibody-like molecule precursor harboring the single-domain antibody; and (c) introducing a protease cleavage sequence into the IgG antibody-like molecule precursor harboring the single-domain antibody.

In one embodiment of the present invention, the method for producing a polypeptide which is an IgG antibody-like molecule comprising a carrying moiety having an inhibiting domain, and an antigen-binding domain is a production method comprising the following steps:
(a) obtaining a single-domain antibody binding to a target antigen;
(b) allowing the single-domain antibody obtained in the step (a) to be associated with a VL as a substitute for VH of an IgG antibody, or allowing the single-domain antibody to be associated with a VH as a substitute for VL of an IgG antibody such that the antigen-binding activity of the single-domain antibody is inhibited, to form an IgG antibody-like molecule precursor harboring the single-domain antibody; and
(c) introducing a protease cleavage sequence to near the boundary between the single-domain antibody and an antibody constant region in the IgG antibody-like molecule precursor.

In one embodiment of the present invention, the method for producing a polypeptide which is an IgG antibody-like molecule comprising a carrying moiety having an inhibiting domain, and an antigen-binding domain is a production method comprising the following steps:
(a) obtaining a single-domain antibody binding to a target antigen; and
(b) linking the single-domain antibody obtained in the step (a) as a substitute for IgG antibody VH or VL to an IgG antibody heavy chain constant region or light chain constant region via a protease cleavage sequence such that the antigen-binding activity of the single-domain antibody is inhibited, to form an IgG antibody-like molecule harboring the single-domain antibody.

In a particular embodiment, the method for producing a polypeptide which is an IgG antibody-like molecule comprising a carrying moiety having an inhibiting domain, and an antigen-binding domain is the production method further comprising the following step:
(d) confirming that the binding activity of the single-domain antibody introduced into the IgG antibody-like molecule or into the IgG antibody-like molecule precursor against the target antigen is weakened or lost.

In the present invention, the phrase "binding activity is weakened" means that the binding activity against the target antigen is decreased as compared with that before the association or the linking, and the degree of this decrease is not limited.

In a particular embodiment, the method for producing a polypeptide which is an IgG antibody-like molecule comprising a carrying moiety having an inhibiting domain, and an antigen-binding domain is the production method further comprising the following step:
(e) releasing the single-domain antibody by the protease cleavage of the protease cleavage sequence and confirming that the released single-domain antibody binds to the target antigen.

In the case of using VH, VL or VHH as the inhibiting domain, the method for inhibiting the antigen-binding activity of the single-domain antibody by the inhibiting domain of the carrying moiety includes a method of allowing the single-domain antibody to be associated with VH, VL or VHH. The VH, the VL or the VHH that inhibits the antigen-binding activity of the provided single-domain antibody can be screened for by allowing known VH, VL or VHH to be associated with the single-domain antibody and comparing the antigen-binding activity of the single-domain antibody between before and after the association.

In another method for inhibiting the antigen-binding activity of the single-domain antibody by particular VH, VL or VHH, an amino acid residue involved in association with VH, VL or VHH, in the single-domain antibody can be substituted to promote the association, or a single-domain antibody/inhibiting domain pair having the desired level of difference in antigen-binding activity between before and after the association can also be provided by using a single-domain antibody originally having, as such an amino acid residue, an amino acid that can promote the association.

In one embodiment of the present invention, the method for producing a polypeptide which is an IgG antibody-like molecule comprising a carrying moiety having an inhibiting domain, and an antigen-binding domain is a production method comprising the following steps:
(a) substituting an amino acid residue in a single-domain antibody that is involved in association with antibody VH, or substituting an amino acid residue in a single-domain antibody that is involved in association with antibody VL to prepare a variant single-domain antibody retaining the binding activity of the single-domain antibody against the target antigen;
(b) allowing the variant single-domain antibody prepared in the step (a) to be associated with antibody VH, or allowing the variant single-domain antibody to be associated with antibody VL such that the antigen-binding activity of the variant single-domain antibody is inhibited, to form an IgG antibody-like molecule precursor harboring the variant single-domain antibody; and
(c) introducing a protease cleavage sequence into the IgG antibody-like molecule precursor harboring the variant single-domain antibody.

In one embodiment of the present invention, the method for producing a polypeptide which is an IgG antibody-like molecule comprising a carrying moiety having an inhibiting domain, and an antigen-binding domain is a production method comprising the following steps:
(a) substituting an amino acid residue in a single-domain antibody that is involved in association with antibody VH, or substituting an amino acid residue in a single-domain antibody that is involved in association with antibody VL, to prepare a variant single-domain antibody retaining the binding activity of the single-domain antibody against the target antigen;
(b) allowing the variant single-domain antibody prepared in the step (a) to be associated with antibody VH, or allowing the variant single-domain antibody to be associated with antibody VL such that the antigen-binding activity of the variant single-domain antibody is inhibited, to form an IgG antibody-like molecule precursor harboring the variant single-domain antibody; and
(c) introducing a protease cleavage sequence to near the boundary between the variant single-domain antibody and a constant region in the IgG antibody-like molecule precursor.

In one embodiment of the present invention, the method for producing a polypeptide which is an IgG antibody-like molecule comprising a carrying moiety having an inhibiting domain, and an antigen-binding domain is a production method comprising the following steps:
(a) substituting an amino acid residue in a single-domain antibody that is involved in association with antibody VH, or substituting an amino acid residue in a single-domain antibody that is involved in association with antibody VL, to prepare a variant single-domain antibody retaining the binding activity of the single-domain antibody against the target antigen; and (b) linking the variant single-domain antibody prepared in the step (a) to an IgG antibody heavy chain constant region via a protease cleavage sequence, or linking the variant single-domain antibody to an IgG antibody light chain constant region via a protease cleavage sequence such that the antigen-binding activity of the variant single-domain antibody is inhibited, to form an IgG antibody-like molecule harboring the variant single-domain antibody.

In a particular embodiment, the method for producing a polypeptide which is an IgG antibody-like molecule comprising a carrying moiety having an inhibiting domain, and an antigen-binding domain is the production method further comprising the following step:

(d) confirming that the binding activity of the variant single-domain antibody harbored in the IgG antibody-like molecule or the IgG antibody-like molecule precursor against the target antigen is weakened or lost.

In the present invention, the phrase "binding activity is weakened" means that the binding activity against the target antigen is decreased as compared with that before the association or the linking, and the degree of this decrease is not limited.

In a particular embodiment, the method for producing a polypeptide which is an IgG antibody-like molecule comprising a carrying moiety having an inhibiting domain, and an antigen-binding domain is the production method further comprising the following step:

(e) releasing the variant single-domain antibody by the protease cleavage of the protease cleavage sequence and confirming that the released variant single-domain antibody binds to the target antigen.

The present invention also relates to polynucleotides each encoding the polypeptide comprising a carrying moiety having an inhibiting domain, and an antigen-binding domain.

The polynucleotide according to the present invention is usually carried by (or inserted into) an appropriate vector and transfected into host cells. The vector is not particularly limited as long as the vector can stably retain an inserted nucleic acid. For example, when E. coli is used as the host, a pBluescript vector (manufactured by Stratagene Corp.) or the like is preferred as a vector for cloning. Various commercially available vectors can be used. In the case of using the vector for the purpose of producing the polypeptide of the present invention, an expression vector is particularly useful. The expression vector is not particularly limited as long as the vector permits expression of the polypeptide in vitro, in E. coli, in cultured cells, or in organism individuals. The expression vector is preferably, for example, a pBEST vector (manufactured by Promega Corp.) for in vitro expression, a pET vector (manufactured by Invitrogen Corp.) for E. coli, a pME18S-FL3 vector (GenBank Accession No. AB009864) for cultured cells, and a pME18S vector (Mol Cell Biol. 8: 466-472 (1988)) for organism individuals. The insertion of the DNA of the present invention into the vector can be performed by a routine method, for example, ligase reaction using restriction sites (Current protocols in Molecular Biology edit. Ausubel et al. (1987) Publish. John Wiley & Sons. Section 11.4-11.11).

The host cells are not particularly limited, and various host cells are used according to the purpose. Examples of the cells for expressing the polypeptide can include bacterial cells (e.g., Streptococcus, Staphylococcus, E. coli, Streptomyces, and Bacillus subtilis), fungal cells (e.g., yeasts and Aspergillus), insect cells (e.g., Drosophila S2 and Spodoptera SF9), animal cells (e.g., CHO, COS, HeLa, C127, 3T3, BHK, HEK293, and Bowes melanoma cells) and plant cells. The transfection of the vector to the host cells may be performed by a method known in the art, for example, a calcium phosphate precipitation method, an electroporation method (Current protocols in Molecular Biology edit. Ausubel et al., (1987) Publish. John Wiley & Sons. Section 9.1-9.9), a Lipofectamine method (manufactured by GIBCO-BRL), or a microinjection method.

An appropriate secretory signal can be incorporated into the polypeptide of interest in order to secrete the polypeptide expressed in the host cells to the lumen of the endoplasmic reticulum, periplasmic space, or an extracellular environment. The signal may be endogenous to the polypeptide of interest or may be a foreign signal.

When the polypeptide of the present invention is secreted into a medium, the recovery of the polypeptide in the production method is performed by the recovery of the medium. When the polypeptide of the present invention is produced in cells, the cells are first lysed, followed by the recovery of the polypeptide.

Methods known in the art including ammonium sulfate or ethanol precipitation, acid extraction, anion- or cation-exchange chromatography, phosphocellulose chromatography, hydrophobic interaction chromatography, affinity chromatography, hydroxyapatite chromatography, and lectin chromatography can be used for recovering and purifying the polypeptide of the present invention from the recombinant cell culture.

Examples of the antigen-binding domain used in some embodiments of the present invention include a single-domain antibody. In these embodiments, the antigen-binding activity of the single-domain antibody can be inhibited by its association with particular VL, by its association with particular VH, or by its association with particular VHH. The present invention also relates to methods for screening for such single-domain antibodies.

VL, VH or VHH having a known sequence, for example, VL, VH or VHH having a sequence registered in the IMGT or Kabat database, can be used as the VL, the VH or the VHH that inhibits the antigen-binding activity of the single-domain antibody. Also, a VL, VH or VHH sequence newly identified from a human antibody library or the like can be used. The VL, the VH or the VHH that inhibits the binding activity of the single-domain antibody can be selected by preparing a protein by the combination of these sequences and measuring the binding activity by use of the method described above.

In some embodiments of the present invention, VL, VH or VHH having a human antibody germline sequence can be used as the VL, the VH or the VHH that inhibits the antigen-binding activity of the single-domain antibody. In the case of using, for example, VL as the inhibiting domain, VL having kappa chain framework sequences or VL having lambda chain framework sequences can be used. Also, VL having modified framework sequences such as combined framework sequences of kappa chain and lambda chain framework sequences can be used.

In one embodiment, the present invention provides a method for screening for a single-domain antibody whose antigen-binding activity can be inhibited by its association with particular VL, comprising the following steps:

(a) obtaining a single-domain antibody having target antigen-binding activity;
(b) allowing the single-domain antibody obtained in the step (a) to be associated with a particular VL; and
(c) confirming that the binding activity of the single-domain antibody associated with the particular VL in the step (b) against the antigen is weakened or lost.

In the present invention, the phrase "binding activity is weakened" means that the binding activity against the target antigen is decreased as compared with that before the association, and the degree of this decrease is not limited.

In one embodiment, the present invention provides a method for screening for a single-domain antibody whose antigen-binding activity can be inhibited by its association with particular VH, comprising the following steps:
(a) obtaining a single-domain antibody having target antigen-binding activity;
(b) allowing the single-domain antibody obtained in the step (a) to be associated with a particular VH; and
(c) confirming that the binding activity of the single-domain antibody associated with the particular VH in the step (b) against the antigen is weakened or lost.

In the present invention, the phrase "binding activity is weakened" means that the binding activity against the target antigen is decreased as compared with that before the association, and the degree of this decrease is not limited.

In one embodiment, the present invention provides a method for screening for a single-domain antibody whose antigen-binding activity can be inhibited by its association with particular VHH, comprising the following steps:
(a) obtaining a single-domain antibody having target antigen-binding activity;
(b) allowing the single-domain antibody obtained in the step (a) to be associated with a particular VHH; and
(c) confirming that the binding activity of the single-domain antibody associated with the particular VHH in the step (b) against the antigen is weakened or lost.

In the present invention, the phrase "binding activity is weakened" means that the binding activity against the target antigen is decreased as compared with that before the association, and the degree of this decrease is not limited.

Examples of the method for allowing the single-domain antibody to be associated with the particular VL, VH or VHH include a method of designing a molecule having the sequence of the single-domain antibody as a substitute for the sequence of one of VH and VL in an antibody or an antibody fragment comprising both VH and VL, such as an intact antibody, Fab, Fab', or (Fab)2, and expressing a polypeptide having the sequence.

The present invention also relates to a method for producing a single-domain antibody whose antigen-binding activity is inhibited by promoting the association of the single-domain antibody with particular VL, by promoting the association of the single-domain antibody with particular VH, or by promoting the association of the single-domain antibody with particular VHH, in addition to screening for a single-domain antibody whose antigen-binding activity is inhibited by its association with particular VL, by its association with particular VH, or by its association with particular VHH.

In one embodiment, the present invention provides a method for producing a single-domain antibody whose antigen-binding activity is inhibited by its association with particular VL, comprising the following step:
(a) substituting an amino acid residue in a single-domain antibody that is involved in association with antibody VL, to prepare a variant single-domain antibody retaining the binding activity of the single-domain antibody against the target antigen.

In a particular embodiment, the present invention provides the method for producing a single-domain antibody whose antigen-binding activity is inhibited by its association with particular VL, further comprising the following steps:
(b) allowing the variant single-domain antibody prepared in the step (a) to be associated with the particular VL; and
(c) confirming that the antigen-binding activity of the variant single-domain antibody associated with the VL is weakened or lost.

In the present invention, the phrase "binding activity is weakened" means that the binding activity against the target antigen is decreased as compared with that before the association, and the degree of this decrease is not limited.

In one embodiment, the present invention provides a method for producing a single-domain antibody whose antigen-binding activity is inhibited by its association with particular VH, comprising the following step:
(a) substituting an amino acid residue in a single-domain antibody that is involved in association with antibody VH, to prepare a variant single-domain antibody retaining the binding activity of the single-domain antibody against the target antigen.

In a particular embodiment, the present invention provides the method for producing a single-domain antibody whose antigen-binding activity is inhibited by its association with particular VH, further comprising the following steps:
(b) allowing the variant single-domain antibody prepared in the step (a) to be associated with the particular VH; and
(c) confirming that the antigen-binding activity of the variant single-domain antibody associated with the VH is weakened or lost.

In the present invention, the phrase "binding activity is weakened" means that the binding activity against the target antigen is decreased as compared with that before the association, and the degree of this decrease is not limited.

In one embodiment, the present invention provides a method for producing a single-domain antibody whose antigen-binding activity is inhibited by its association with particular VHH, comprising the following step:
(a) substituting an amino acid residue in a single-domain antibody that is involved in association with VHH, to prepare a variant single-domain antibody retaining the binding activity of the single-domain antibody against the target antigen.

In a particular embodiment, the present invention provides the method for producing a single-domain antibody whose antigen-binding activity is inhibited by its association with particular VHH, further comprising the following steps:
(b) allowing the variant single-domain antibody prepared in the step (a) to be associated with the particular VHH; and
(c) confirming that the antigen-binding activity of the variant single-domain antibody associated with the VHH is weakened or lost.

In the present invention, the phrase "binding activity is weakened" means that the binding activity against the target antigen is decreased as compared with that before the association, and the degree of this decrease is not limited.

The step of allowing association of the single-domain antibody with the particular VL, VH or VHH is performed by a method of designing a molecule having the sequence of the single-domain antibody as a substitute for the sequence of one of VH and VL in an antibody or an antibody fragment comprising both VH and VL, such as an intact antibody, Fab, Fab', or (Fab)$_2$, and expressing a polypeptide having the sequence.

According to a certain embodiment of the present invention, the single-domain antibody of the present invention whose antigen-binding activity is inhibited or lost by its association with particular VL, VH or VHH can be obtained from a library comprising a plurality of fusion polypeptides of single-domain antibodies each linked to a first association sustaining domain.

In the present specification, an embodiment of the "library" can provide a library that permits efficient obtainment of a single-domain antibody whose antigen-binding activity is inhibited or lost by its association with particular VL, VH or VHH.

In the present specification, the "library" refers to a set of a plurality of fusion polypeptides having different sequences, or a set of nucleic acids or polynucleotides encoding these fusion polypeptides. A plurality of fusion polypeptides contained in the library are fusion polypeptides differing in sequence from each other, not having a single sequence.

In the present specification, the term "differing in sequence from each other" in a plurality of fusion polypeptides differing in sequence from each other means that the individual fusion polypeptides in the library have distinct sequences. More preferably, the term means that the single-domain antibody moieties of the individual fusion polypeptides in the library have distinct sequences. Specifically, the number of the distinct sequences in the library reflects the number of independent clones differing in sequences in the library and is also referred to as a "library size". The library size of a usual phage display library is 106 to 1012 and may be expanded to 1014 by the application of a technique known in the art such as a ribosome display method. However, the actual number of phage particles for use in panning selection for the phage library is usually 10 to 10,000 times larger than the library size. This excessive multiple, also called the "number of equivalents of the library", represents that 10 to 10,000 individual clones may have the same amino acid sequence. Accordingly, the term "differing in sequence from each other" according to the present invention means that the individual polypeptides in the library excluding the number of equivalents of the library have distinct sequences and more specifically means that the library has 106 to 1014 molecules, preferably 107 to 1012 molecules, of polypeptides differing in sequence from each other.

The term "plurality of" in the library consisting essentially of a plurality of fusion polypeptides according to the present invention usually refers to a set of two or more types of substances as to, for example, the polypeptide, polynucleotide molecule, vector, or virus of the present invention. Provided that, for example, two or more substances differ in particular trait from each other, this means that the substances are of two or more types. Examples thereof can include a mutant amino acid observed at a particular amino acid position in an amino acid sequence. For example, two or more polypeptides of the present invention having substantially the same, preferably identical sequences, except for particular mutant amino acids at surface-exposed, highly diverse amino acid positions are regarded as a plurality of polypeptides of the present invention. In another example, two or more polynucleotide molecules of the present invention having substantially the same, preferably identical sequences except for bases encoding particular mutant amino acids at surface-exposed, highly diverse amino acid positions are regarded as a plurality of polynucleotide molecules of the present invention.

Panning methods that utilize phage vectors are also preferably used as a method for screening the fusion polypeptides with binding activity as an index. A gene encoding each single-domain antibody and a gene encoding an IgG antibody CH1 domain or a light chain constant region can be linked in an appropriate form to form a fusion polypeptide. Genes encoding the fusion polypeptides thus formed can be inserted into phage vectors to obtain phages expressing the fusion polypeptides on the surface. After contact of the phages with the desired antigen, phages bound with the antigen can be recovered to recover DNAs encoding fusion polypeptides having the binding activity of interest. This operation can be repeated, if necessary, to enrich fusion polypeptides having the desired binding activity.

In addition to the phage display method, a technique using a cell-free translation system, a technique of presenting fusion polypeptides on cell or virus surface, a technique of using an emulsion, and the like are known as techniques of obtaining fusion polypeptides by panning using a library. For example, a ribosome display method of forming a complex of mRNA and a translated protein via ribosome by the removal of a stop codon, etc., a cDNA or mRNA display method of covalently binding a gene sequence to a translated protein using a compound such as puromycin, or a CIS display method of forming a complex of a gene and a translated protein using a nucleic acid binding protein can be used as the technique using a cell-free translation system. For example, the phage display method as well as an E. coli display method, a gram-positive bacterium display method, a yeast display method, a mammalian cell display method, or a virus display method can be used as the technique of presenting fusion polypeptides on cell or virus surface. For example, an in vitro virus display method using an emulsion containing a gene and a translation-related molecule can be used as the technique using an emulsion. These methods are already known in the art (Nat Biotechnol. 2000 December; 18(12): 1287-92, Nucleic Acids Res. 2006; 34(19): e127, Proc Natl Acad Sci USA. 2004 Mar. 2; 101(9): 2806-10, Proc Natl Acad Sci USA. 2004 Jun. 22; 101(25): 9193-8, Protein Eng Des Sel. 2008 April; 21(4): 247-55, Proc Natl Acad Sci USA. 2000 Sep. 26; 97(20): 10701-5, MAbs. 2010 September-October; 2(5): 508-18, Methods Mol Biol. 2012; 911: 183-98).

An association partner of an inhibiting domain linked to a second association sustaining domain can be used in a method for obtaining the single-domain antibody of interest from the library comprising a plurality of fusion polypeptides of single-domain antibodies each linked to a first association sustaining domain.

In the present specification, the "first association sustaining domain" and the "second association sustaining domain" refer to domains that can interact with each other through a bond such as a hydrophobic bond, a hydrogen bond, or an ionic bond to form an association product. Preferred examples of the first association sustaining domain and the second association sustaining domain include, but are not limited to, antibody light chain constant regions (CL) and CH1 domains of heavy chain constant regions.

The first association sustaining domain and the second association sustaining domain can interact with each other and form the association of the fusion polypeptide with the association partner, regardless of the degree of associativity between the single-domain antibody and the inhibiting domain.

In an alternative embodiment, the present invention provides a library comprising a plurality of fusion polypeptides of single-domain antibodies linked to an IgG antibody light chain constant region, wherein the single-domain antibodies include a single-domain antibody whose antigen-binding activity is inhibited or lost by its association with particular VL, VH or VHH, and a method for screening the library for a single-domain antibody whose antigen-binding activity can be inhibited or could lost by association with particular VL, VH or VHH.

Figure 9A:
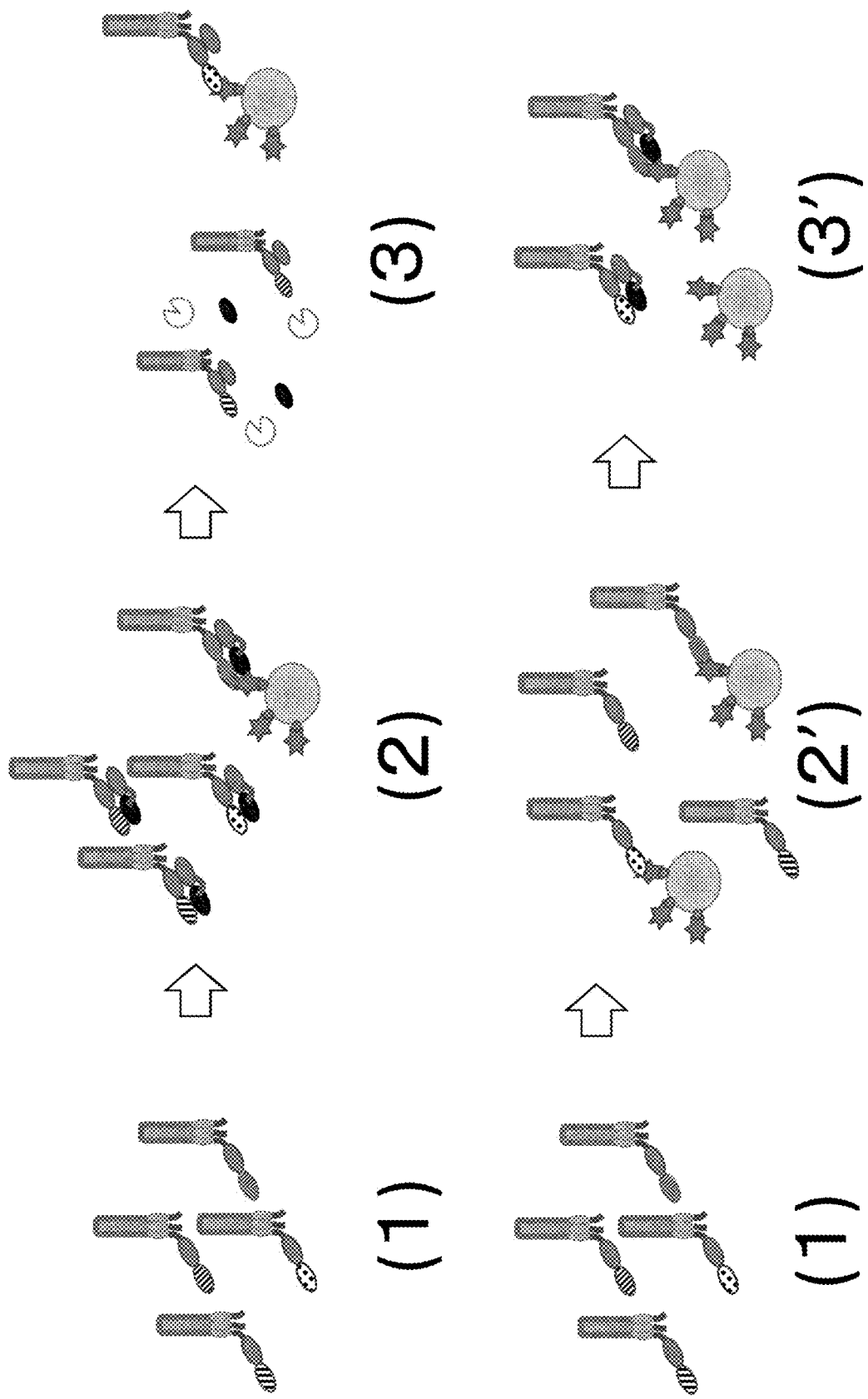
FIG. 9A is a diagram showing one example of a method for screening for a fusion polypeptide comprising a single-domain antibody whose antigen-binding activity can be inhibited or could lost by its association with a particular inhibiting domain, from a library comprising a plurality of fusion polypeptides of single-domain antibodies each linked to a first association sustaining domain.

In a specific embodiment, as shown in FIGS. 9A(1), 9A(2), 9A(3), 9B, and 9C,
(1) fusion polypeptides of single-domain antibodies each linked to a first association sustaining domain are displayed on the surface of phages or the like by a display method such as phage display.
(2) An association partner of an inhibiting domain linked to a second association sustaining domain is provided, and the fusion polypeptides are associated with the association partner. A fusion polypeptide that does not bind to the target antigen or has antigen-binding activity of a predetermined value or lower in this state of the fusion polypeptide associated with the association partner is selected.
(3) The association of the single-domain antibody in the fusion polypeptide selected in (2) with the inhibiting domain in the association partner is canceled. A fusion polypeptide that binds to the target antigen or has antigen-binding activity of a predetermined value or higher in a state where the single-domain antibody is not associated with the inhibiting domain is selected.

Figure 9B:
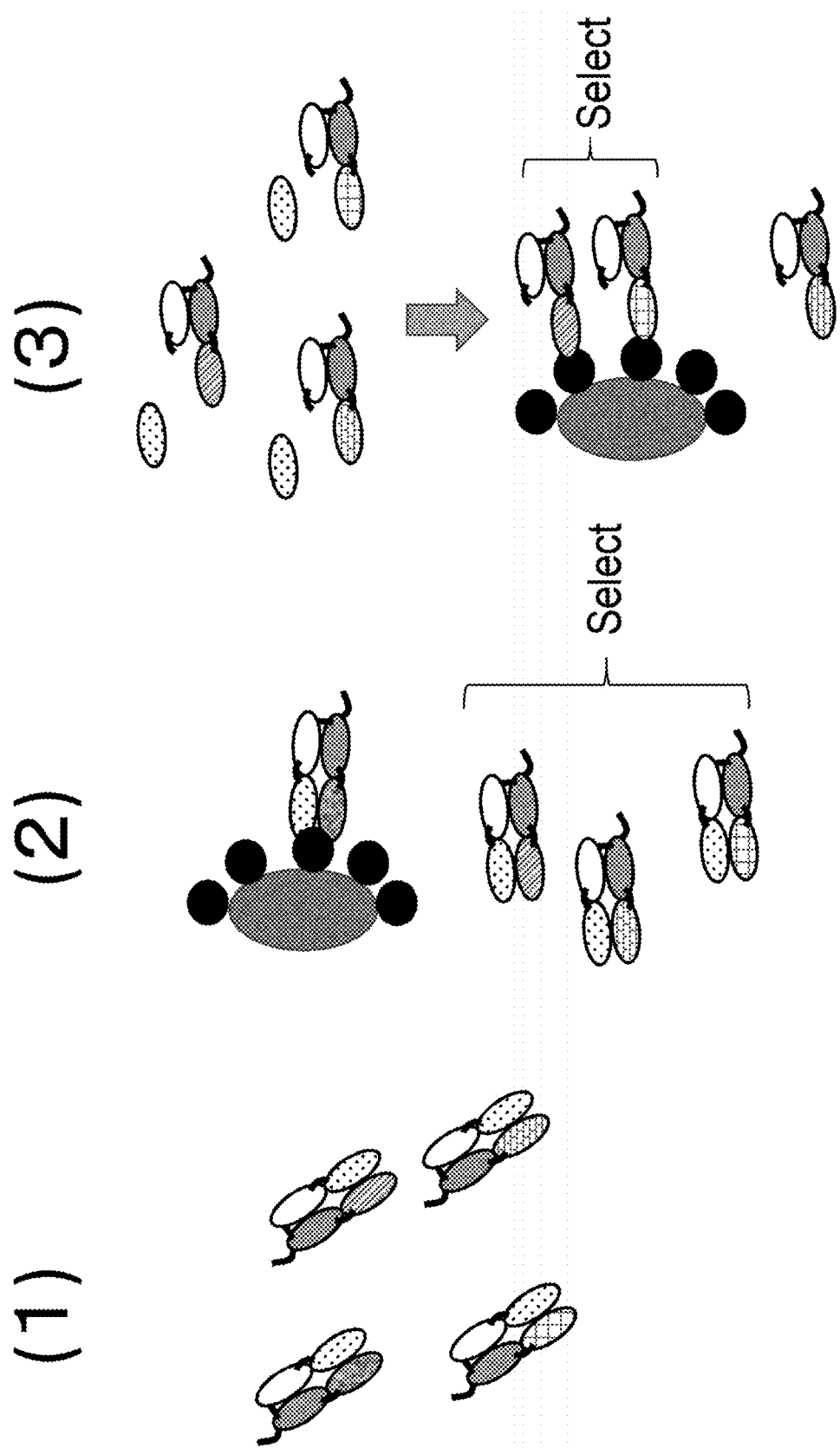
FIG. 9B is a diagram showing one more specific example of the method for screening for a fusion polypeptide comprising a single-domain antibody whose antigen-binding activity can be inhibited or could lost by its association with a particular inhibiting domain, from a library comprising a plurality of fusion polypeptides of single-domain antibodies each linked to a first association sustaining domain. (1) The fusion polypeptides each comprising a single-domain antibody and a first association sustaining domain and an association partner harboring a protease cleavage sequence between an inhibiting domain and a second association sustaining domain are displayed together to form a Fab-like structure; (2) from among the Fab-like structures thus displayed, a structure that does not bind to the antigen or has antigen-binding activity of a predetermined value or lower is selected; and (3) the association partner is cleaved by protease, and a fragment comprising a single-domain antibody that binds to the antigen or has antigen-binding activity of a predetermined value or higher is selected.
Figure 9C:
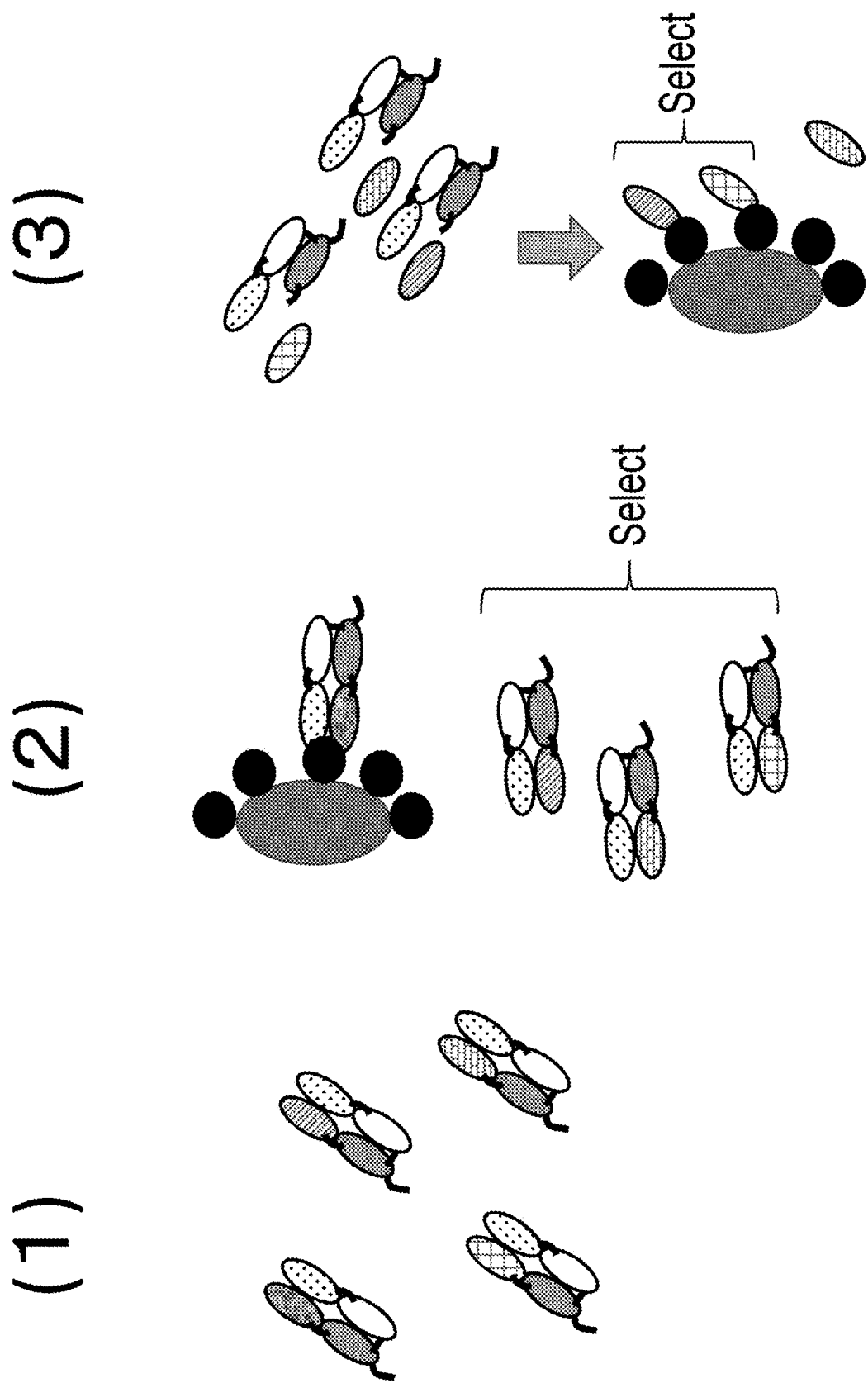
FIG. 9C is a diagram showing another more specific example of the method for screening for a fusion polypeptide comprising a single-domain antibody whose antigen-binding activity can be inhibited or could lost by its association with a particular inhibiting domain, from a library comprising a plurality of fusion polypeptides of single-domain antibodies each linked to a first association sustaining domain. (1) The fusion polypeptides each harboring a protease cleavage sequence between a single-domain antibody and a first association sustaining domain and an association partner of an inhibiting domain linked to a second association sustaining domain are displayed together to form a Fab-like structure; (2) from among the Fab-like structures thus displayed, a structure that does not bind to the antigen or has antigen-binding activity of a predetermined value or lower is selected; and (3) the fusion polypeptide is cleaved by protease, and a fragment comprising a single-domain antibody that binds to the antigen or has antigen-binding activity of a predetermined value or higher is selected.

In this context, for example, a method of cleaving the association partner near the boundary between the inhibiting domain and the second association sustaining domain as shown in FIG. 9B, or a method of cleaving the fusion polypeptide near the boundary between the single-domain antibody and the first association sustaining domain as shown in FIG. 9C can be used as a method for canceling the association of the single-domain antibody with the inhibiting domain.

Figure 9D:
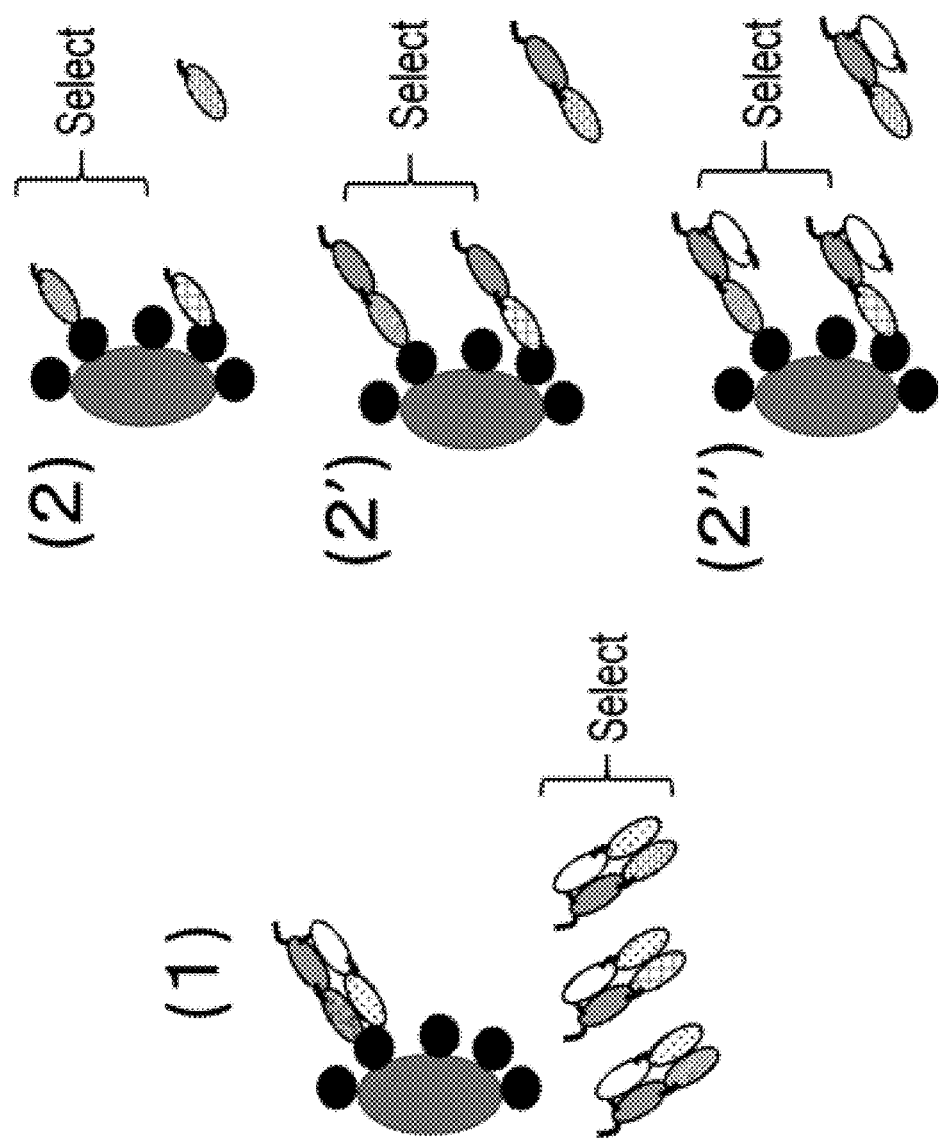
FIG. 9D is a diagram showing an alternative example of the method for screening for a fusion polypeptide comprising a single-domain antibody whose antigen-binding activity can be inhibited or could lost by its association with a particular inhibiting domain, from a library comprising a plurality of fusion polypeptides of single-domain antibodies each linked to a first association sustaining domain. (1) The fusion polypeptides each comprising a single-domain antibody and a first association sustaining domain and an association partner of an inhibiting domain linked to a second association sustaining domain are displayed together to form a Fab-like structure, and from among the Fab-like structures thus displayed, a structure that does not bind to the antigen or has antigen-binding activity of a predetermined value or lower is selected; and (2) moieties comprising the single-domain antibodies in the Fab-like structures thus selected in (1) are displayed again so as not to express the inhibiting domain at the same time therewith, and a fragment that binds to the antigen or has antigen-binding activity of a predetermined value or higher is selected. Each of FIGS. 9D(2') and 9D(2") is a diagram showing an alternative embodiment in which the moieties comprising the single-domain antibodies in (2) are displayed again so as not to express the inhibiting domain together therewith. The order of (1) and (2), (2') or (2") may be (2), (2') or (2") preceding (1). Specifically, the moieties comprising the single-domain antibodies are displayed so as not to express the inhibiting domain together therewith, and a fragment having antigen-binding activity of a predetermined value or higher is selected. Next, fusion polypeptides each comprising a single-domain antibody comprising the fragment having predetermined or larger binding and a first association sustaining domain, and an association partner of an inhibiting domain linked to a second association sustaining domain are displayed together to form a Fab-like structure, and from among the Fab-like structures thus displayed, a structure that does not bind to the antigen or has antigen-binding activity of a predetermined value or lower is selected.

In a further embodiment, the present invention provides a method comprising, as shown in FIG. 9D, comparing the difference in the binding activity of the single-domain antibody between when the single-domain antibody and the inhibiting domain are expressed together and when the single-domain antibody is expressed so as not to express the inhibiting domain together therewith, instead of comparing the difference in the binding activity of the single-domain antibody between the canceled association and non-canceled association of the single-domain antibody with the inhibiting domain as shown in FIGS. 9A to 9C.

As shown in FIG. 9D(1), the single-domain antibody and the inhibiting domain are expressed together to form association. A fusion polypeptide comprising a single-domain antibody that does not bind to the antigen or has antigen-binding activity of a predetermined value or lower in this state is selected. As shown in FIGS. 9D(2), 9D(2'), and 9D(2"), the single-domain antibody is expressed so as not to express the inhibiting domain together therewith. A fusion polypeptide comprising a single-domain antibody that binds to the antigen or has antigen-binding activity of a predetermined value or higher in this state is selected. As a result, the single-domain antibody whose antigen-binding activity is inhibited or lost by its association with a particular inhibiting domain, for example, VH, VL or VHH may be screened for from the library comprising a plurality of fusion polypeptides of single-domain antibodies each linked to a first association sustaining domain. Alternatively, the single-domain antibody is expressed so as not to express the inhibiting domain together therewith. A polypeptide comprising a single-domain antibody that binds to the antigen or has antigen-binding activity of a predetermined value or higher in this state is selected. Then, the single-domain antibody and the inhibiting domain are expressed together to form association. A polypeptide comprising a single-domain antibody that does not bind to the antigen or has antigen-binding activity of a predetermined value or lower in this state is selected. By this method as well, the single-domain antibody whose antigen-binding activity is inhibited or lost by its association with a particular inhibiting domain, for example, VH, VL or VHH may be screened for from the library comprising a plurality of fusion polypeptides of single-domain antibodies each linked to a first association sustaining domain. Alternatively, as shown in FIGS. 9D(2), 9D(2'), and 9D(2"), the single-domain antibody is expressed so as not to express the inhibiting domain together therewith (only the single-domain antibody is expressed; only the fusion polypeptide comprising a single-domain antibody and a first association sustaining domain is expressed; or the fusion polypeptide comprising a single-domain antibody and a first association sustaining domain is associated only with the second association sustaining domain), and a fusion polypeptide comprising a single-domain antibody that binds to the antigen or has antigen-binding activity of a predetermined value or higher in this state is selected. Then, as shown in FIG. 9D(1), the single-domain antibody in the selected fusion polypeptide and the inhibiting domain are expressed together to form association. A fusion polypeptide comprising a single-domain antibody that does not bind to the antigen or has antigen-binding activity of a predetermined value or lower in this state is selected. As a result, the single-domain antibody whose antigen-binding activity is inhibited or lost by its association with a particular inhibiting domain, for example, VH, VL or VHH may also be screened for from the library comprising a plurality of fusion polypeptides of single-domain antibodies each linked to a first association sustaining domain.

The "antigen-binding activity of a predetermined value or lower" can refer to, for example, antigen-binding activity that falls below a predetermined reference when the antigen-binding activity is measured by the method listed in the present specification. Likewise, the "antigen-binding activity of a predetermined value or higher" can refer to, for example, antigen-binding activity that exceeds a predetermined reference when the antigen-binding activity is measured by the method listed in the present specification. A fusion polypeptide having the antigen-binding activity of a predetermined value or higher binds more strongly to the antigen than a fusion polypeptide having the antigen-binding activity of a predetermined value or lower.

The fusion polypeptide selected in (3) described above comprises a single-domain antibody that has no or weak antigen-binding activity in a state of association with the inhibiting domain and has (or has strong) antigen-binding activity in a state of non-association with the inhibiting domain. The sequence of the fusion polypeptide selected by such a method can be analyzed to also elucidate the sequence of the single-domain antibody contained therein. Thus, the single-domain antibody can be produced.

For the methods for screening for a fusion polypeptide comprising the single-domain antibody of interest by using fusion polypeptides and an association partner, it is important to compare the antigen-binding activity of the single-domain antibody between states of association and non-association with the inhibiting domain. As shown in FIGS. 9A(2') and 9A(3'), the antigen-binding activity of the displayed fusion polypeptides is first confirmed, and fusion polypeptides that bind to the antigen or has antigen-binding activity of a predetermined value or higher are selected. Then, the fusion polypeptides thus selected are allowed to be associated with the association partner. Fusion polypeptides that do not bind to the antigen or have antigen-binding activity of a predetermined value or lower in this state of association are selected. By this method as well, the fusion polypeptides comprising the single-domain antibody of interest can be obtained.

Hereinafter, some embodiments using an IgG antibody CH1 domain as the first association sustaining domain and using IgG antibody CL as the second association sustaining domain will be described.

A fusion polypeptide comprising the single-domain antibody of interest can be screened for from a library comprising a plurality of fusion polypeptides of single-domain antibodies each linked to an IgG antibody CH1 domain.

In some embodiments, the present invention provides a library comprising a plurality of fusion polypeptides of single-domain antibodies each linked to an IgG antibody CH1 domain, wherein the single-domain antibodies include a single-domain antibody whose antigen-binding activity is inhibited or lost by its association with particular VL, VH or VHH, and a method for screening the library for a fusion polypeptide comprising a single-domain antibody whose antigen-binding activity can be inhibited or could lost by its association with particular VL, VH or VHH.

In a particular embodiment, the present invention provides a method for screening for a fusion polypeptide comprising a single-domain antibody whose antigen-binding activity can be inhibited or could lost by its association with particular VL, from a library comprising a plurality of fusion polypeptides of single-domain antibodies each linked to an IgG antibody CH1 domain. Specifically, the present invention provides a method for screening for a single-domain antibody, comprising the following steps:
  (a) allowing the fusion polypeptides of the library according to the present invention to be displayed in vitro;
  (b) providing an association partner of an IgG antibody light chain constant region fused with the particular VL;
  (c) allowing each of the fusion polypeptides displayed in the step (a) to be associated with the association partner provided in the step (b) and selecting a fusion polypeptide(s) that does not bind to the antigen or has antigen-binding activity of a predetermined value or lower in a state where the single-domain antibody is associated with the VL; and
  (d) selecting, from the fusion polypeptide(s) thus selected in the step (c), a fusion polypeptide that binds to the antigen or has antigen-binding activity of a predetermined value or higher in a state where the single-domain antibody contained therein is not associated with the VL.

The association partner provided in the step (b) further comprises a protease cleavage sequence. In this case, in the step (d), the association of the single-domain antibody with the VL is canceled by protease treatment, and the antigen-binding activity of the single-domain antibody may be confirmed in a state where the single-domain antibody is not associated with the VL. The protease cleavage sequence in the association partner is not limited by its position as long as the association of the single-domain antibody with the VL is canceled by cleavage. As an example of the position, the protease cleavage sequence may be located, for example, near the boundary between the VL and the IgG antibody light chain constant region in the association partner, preferably at any position between the amino acid of position 96 (Kabat numbering) of the VL and the amino acid of position 130 (EU numbering) (Kabat numbering position 130) of the antibody light chain constant region, more preferably at any position between the amino acid of position 104 (Kabat numbering) of the VL and the amino acid of position 113 (EU numbering) (Kabat numbering position 113) of the antibody light chain constant region.

Instead of using the association partner comprising a protease cleavage sequence, the protease cleavage sequence may be introduced into the fusion polypeptides in the library, and the fusion polypeptides can be cleaved by protease so that the association of the single-domain antibody with the VL is canceled. The protease cleavage sequence in each fusion polypeptide is not limited by its position as long as the association of the single-domain antibody with the VL is canceled by cleavage and the single-domain antibody retains its antigen-binding activity even after the cleavage. As an example of the position, the protease cleavage sequence may be located, for example, near the boundary between the single-domain antibody and the IgG antibody CH1 domain in the fusion polypeptide.

In the step (d), the full length of the fusion polypeptide(s) selected in the step (c) or their moieties comprising the single-domain antibodies may be displayed again, and the antigen-binding activity of the single-domain antibody can be confirmed in a state where the single-domain antibody is not associated with the VL.

In a particular embodiment, the present invention provides a method for screening for a fusion polypeptide comprising a single-domain antibody whose antigen-binding activity can be inhibited or could lost by its association with particular VH, from a library comprising a plurality of fusion polypeptides of single-domain antibodies each linked to an IgG antibody light chain constant region. Specifically, the present invention provides a method for screening for a fusion polypeptide comprising a single-domain antibody, comprising the following steps:
  (a) allowing the fusion polypeptides of the library according to the present invention to be displayed in vitro;
  (b) providing an association partner of an IgG antibody CH1 domain fused with the particular VH;
  (c) allowing the fusion polypeptides displayed in the step (a) to be associated with the association partner provided in the step (b) and selecting a fusion polypeptide(s) that does not bind to the antigen or has antigen-binding activity of a predetermined value or lower in a state where the single-domain antibody is associated with the VH; and
  (d) selecting, from the fusion polypeptide(s) thus selected in the step (c), a fusion polypeptide that binds to the antigen or has antigen-binding activity of a predetermined value or higher in a state where the single-domain antibody contained therein is not associated with the VH.

The association partner provided in the step (b) further comprises a protease cleavage sequence. In this case, in the step (d), the association of the single-domain antibody with the VH is canceled by protease treatment, and the antigen-binding activity of the single-domain antibody may be confirmed in a state where the single-domain antibody is not associated with the VH. The protease cleavage sequence in the association partner is not limited by its position as long as the association of the single-domain antibody with the VH is canceled by cleavage. As an example of the position, the protease cleavage sequence may be located, for example, near the boundary between the VH and the IgG antibody CH1 domain in the association partner, preferably at any position between the amino acid of position 101 (Kabat numbering) of the VH and the amino acid of position 140 (EU numbering) of the antibody heavy chain constant region, more preferably at any position between the amino acid of position 109 (Kabat numbering) of the VH and the amino acid of position 122 (EU numbering) of the antibody heavy chain constant region.

Instead of using the association partner comprising a protease cleavage sequence, the protease cleavage sequence may be introduced into the fusion polypeptides in the library, and the fusion polypeptides can be cleaved by protease so that the association of the single-domain antibody with the VH is canceled. The protease cleavage sequence in each fusion polypeptide is not limited by its position as long as the association of the single-domain antibody with the VH is canceled by cleavage and the single-domain antibody retains its antigen-binding activity even after the cleavage. As an example of the position, the protease cleavage sequence may be located, for example, near the boundary between the single-domain antibody and the IgG antibody light chain constant region in the fusion polypeptide.

In the step (d), the full length of the fusion polypeptide(s) selected in the step (c) or their moieties comprising the single-domain antibodies may be displayed again, and the antigen-binding activity of the single-domain antibody can be confirmed in a state where the single-domain antibody is not associated with the VH.

Amino acids contained in each amino acid sequence described in the present invention may be posttranslationally modified (e.g., the modification of N-terminal glutamine to pyroglutamic acid by pyroglutamylation is a modification well known to those skilled in the art). Such an amino acid sequence containing the posttranslationally modified amino acid is also included in the amino acid sequence described in the present invention, as a matter of course.

It should be understood by those skilled in the art that arbitrary combinations of one or more embodiments described in the present specification are also included in the present invention unless there is technical contradiction on the basis of the technical common sense of those skilled in the art.

EXAMPLES

Hereinafter, Examples of the method and the composition of the present invention will be described. It shall be understood that various other embodiments can be carried out in light of the general description mentioned above.

Example 1 Problem of Existing Protease-Activated Antibodies

Figures 1, 12:
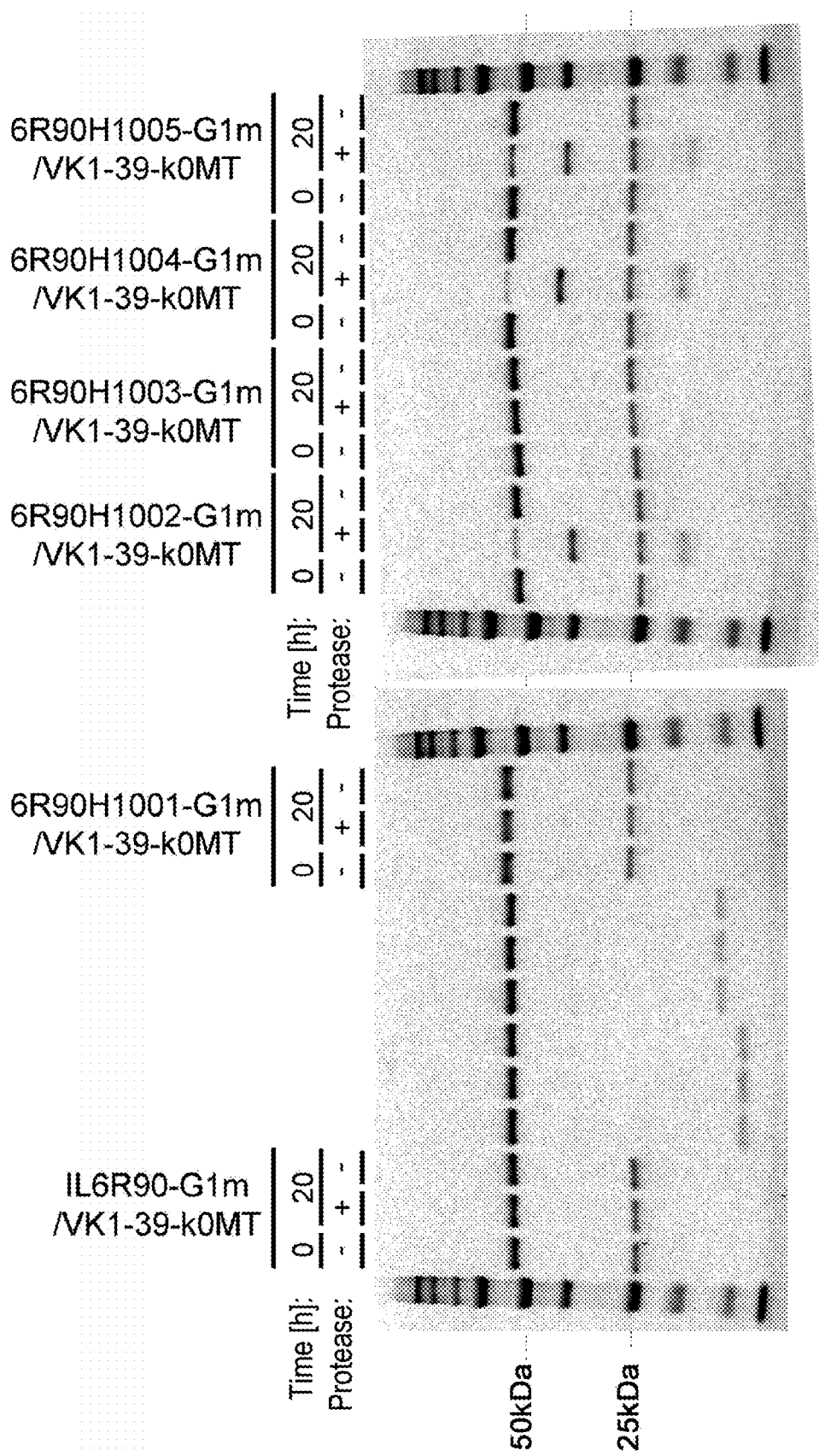
Figures 2, 12:
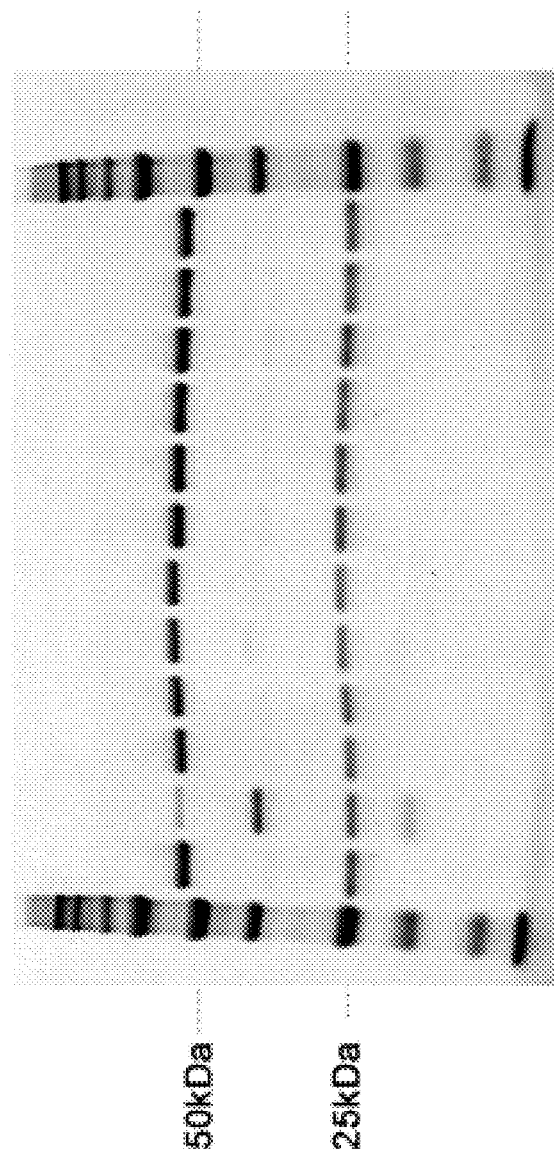

A method for preparing an antibody that exerts antigen-binding activity only through cleavage by protease expressed at a lesion site such as a cancer tissue or an inflammatory tissue has been reported. This antibody, called Probody, is an antibody molecule, as shown in FIG. 1, whose antigen-binding activity is inhibited by connecting an antibody to a peptide masking the antigen-binding site of the antibody via a linker that is cleaved by protease expressed at a lesion site (NPL 18). The masking peptide is dissociated from the Probody by the cleavage of the constituent linker by the protease expressed at the target pathological site so that the resulting antibody molecule restores its antigen-binding activity and becomes capable of binding to the antigen in the target pathological tissue.

It is believed that the Probody can bind to the antigen selectively at the target pathological site under the mechanism as mentioned above and thereby expand the therapeutic window. However, because the cleavage of the antibody by protease is irreversible in the case of Probody, there may be the possibility that the antibody cleaved at the pathological site is capable of being brought back into blood from the pathological site and binds to the antigen expressed in normal tissue as a result of distributing the antibody to the normal tissues through blood flow., The Probody activated by protease retains a Fc region same as in the Probody before the activation and therefore possesses long blood retention. Therefore, the antibody activated by protease expressed at a pathological site might circulate long in blood. Even protease expressed at an elevated level at a pathological site is also expressed at a low level in normal tissues, and free protease produced at a pathological site may be leaked into blood (The Chinese-German Journal of Clinical Oncology June 2004, Vol. 3, No. 2 P78-P80). Therefore, the Probody may be activated by such free protease. Hence, there may be a possibility that the Probody is activated at a site other than a pathological site. The Probody thus activated also circulates long in blood. Thus, there is a possibility that the Probody is continuously activated at a pathological site, in normal tissues, and in blood, and the activated Probody, if having long blood retention, accumulates in blood. The activated Probody accumulated in blood might exhibit side effects by binding to the antigen expressed in normal tissues (FIG. 2).

Figure 3:
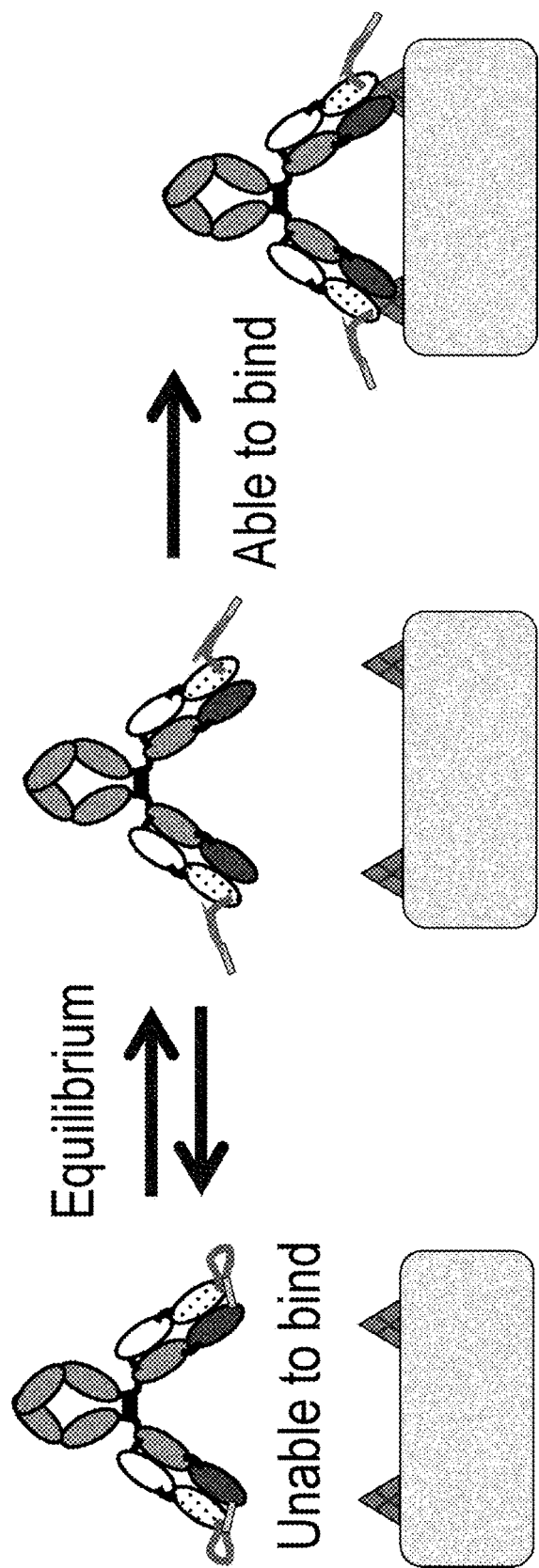
FIG. 3 is a diagram showing a cause of side effects that might be exhibited by Probody. The Probody is in equilibrium between a state where the masking peptide linked via the linker is bound with the antigen-binding site and a state where the masking peptide is dissociated. A molecule in the dissociated state can bind to the antigen.

The antigen-binding activity of the Probody is inhibited by a masking peptide linked to an antibody via a linker, but the antigen-binding activity is not completely inhibited. The Probody is in equilibrium between a state where the masking peptide linked via the linker is bound with the antigen-binding site and a state where the masking peptide is dissociated therefrom. A molecule in the dissociated state can bind to the antigen (FIG. 3). In actuality, anti-EGFR Probody described in NPL 17 has binding activity against EGFR even before protease cleavage of the linker. Although the antigen-binding activity increases 30 to 100 fold by the protease cleavage of the linker, the Probody present at a high concentration before activation might exhibit side effects by binding to the antigen expressed in normal tissues, because the Probody before activation has 1/30 to 1/100 of the binding activity of the activated Probody.

The Probody employs an artificial peptide for masking the antigen-binding site of the antibody. The artificial peptide has a sequence absent in native human proteins and might therefore has immunogenicity in humans. Such immunogenicity is known to decrease the effects of antibody drugs by inducing anti-drug antibodies (Blood. 2016 Mar. 31; 127 (13): 1633-41).

Figure 4:
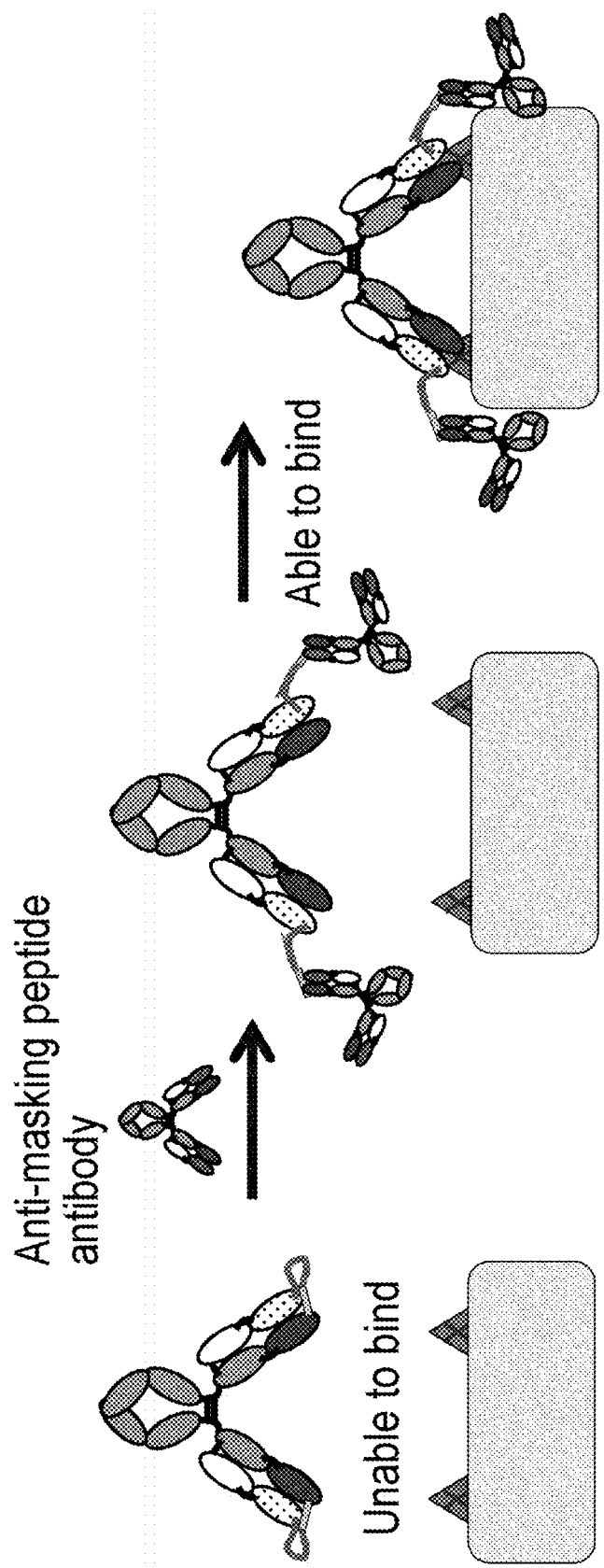
FIG. 4 is a diagram showing a cause of side effects that might be exhibited by Probody. An anti-drug antibody against the masking peptide (anti-masking peptide antibody) might bind to the masking peptide of Probody before activation and thereby activate the Probody without protease cleavage.

Possible anti-drug antibodies against Probody are an anti-drug antibody against a complex of the antibody and the masking peptide (Probody before activation), an anti-drug antibody against the antibody dissociated from the masking peptide (activated Probody), an anti-drug antibody against the masking peptide (masking peptide dissociated from the activated Probody), and the like. Among them, the anti-drug antibody against the masking peptide (anti-masking peptide antibody) might bind to the masking peptide of Probody before activation and thereby activate the Probody even without protease cleavage (FIG. 4). The Probody activated by the anti-masking peptide antibody might exhibit side effects by binding to the antigen expressed in normal tissues.

Example 2 Concept of Protease-Activated Polypeptide Comprising Single-Domain Antibody As shown in Example 1, the Probody technology presents the following problems:
1. Probody activated by protease cleavage has long blood retention.
2. Even Probody before protease cleavage has binding activity against the antigen.
3. The masking peptide is an artificial non-human sequence and may induce anti-masking peptide antibodies.

The present inventors thought that a useful way for solving these problems and providing an antibody drug exerting activity at pathological sites is to satisfy the following conditions:
1. An antigen-binding domain activated by protease cleavage has a short half-life in blood.
2. The antigen-binding activity of a molecule before protease cleavage is minimized.
3. The masking peptide having an artificial non-human sequence is not used.

Figure 5:
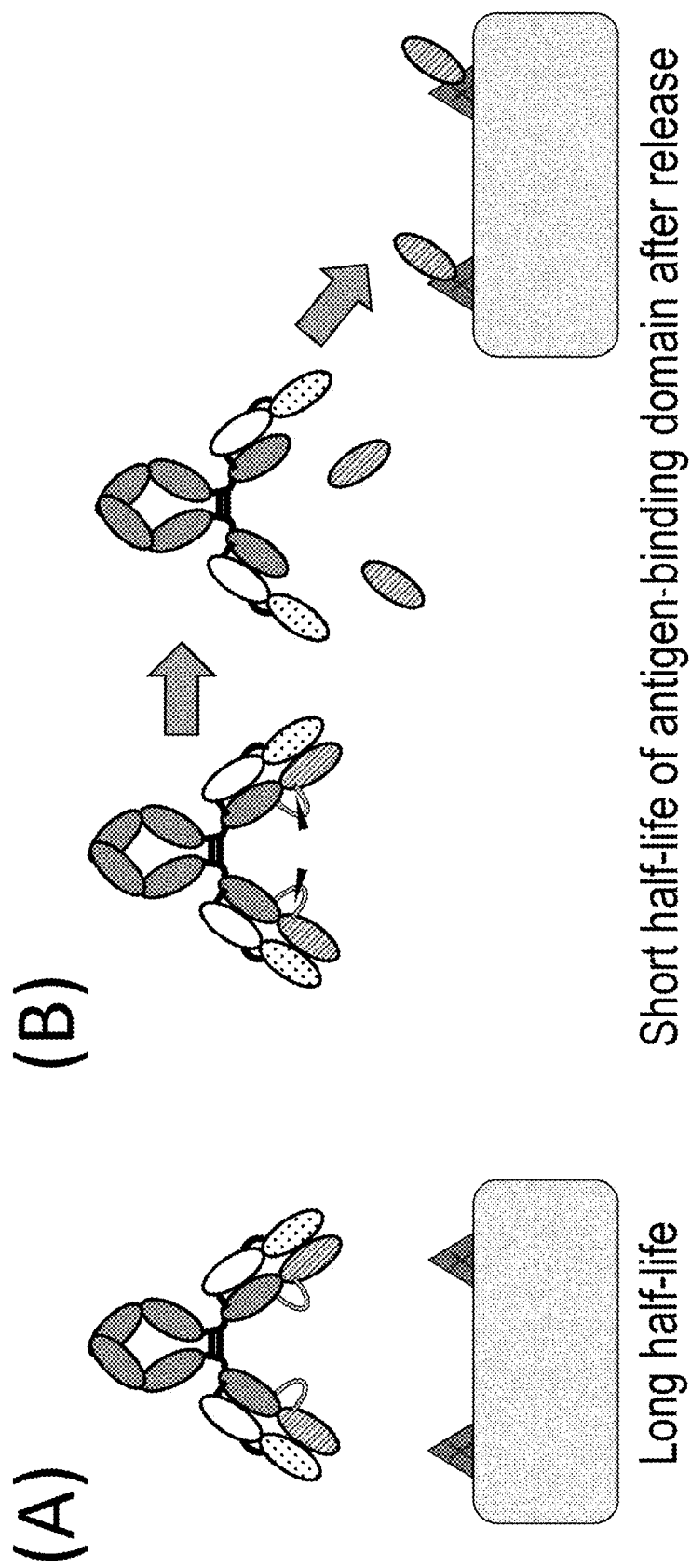
FIG. 5 is a diagram showing the concept of a polypeptide comprising an antigen-binding domain and a carrying moiety. (A) The polypeptide with the antigen-binding domain linked to the carrying moiety has a long half-life and does not bind to the antigen. (B) The antigen-binding domain is released by, for example, cleavage at a cleavage site to bind to the antigen, and the antigen-binding domain thus released has a short half-life.

The present inventors devised a molecule shown in FIG. 5 as one example of a polypeptide that satisfies the conditions described above. The polypeptide with an antigen-binding domain linked to a carrying moiety has a long half-life and does not bind to the antigen because the antigen-binding activity of the antigen-binding domain is inhibited (A). The antigen-binding domain is released, and the antigen-binding domain thus released restores its antigen-binding activity and also has a short half-life (B).

Figure 6:
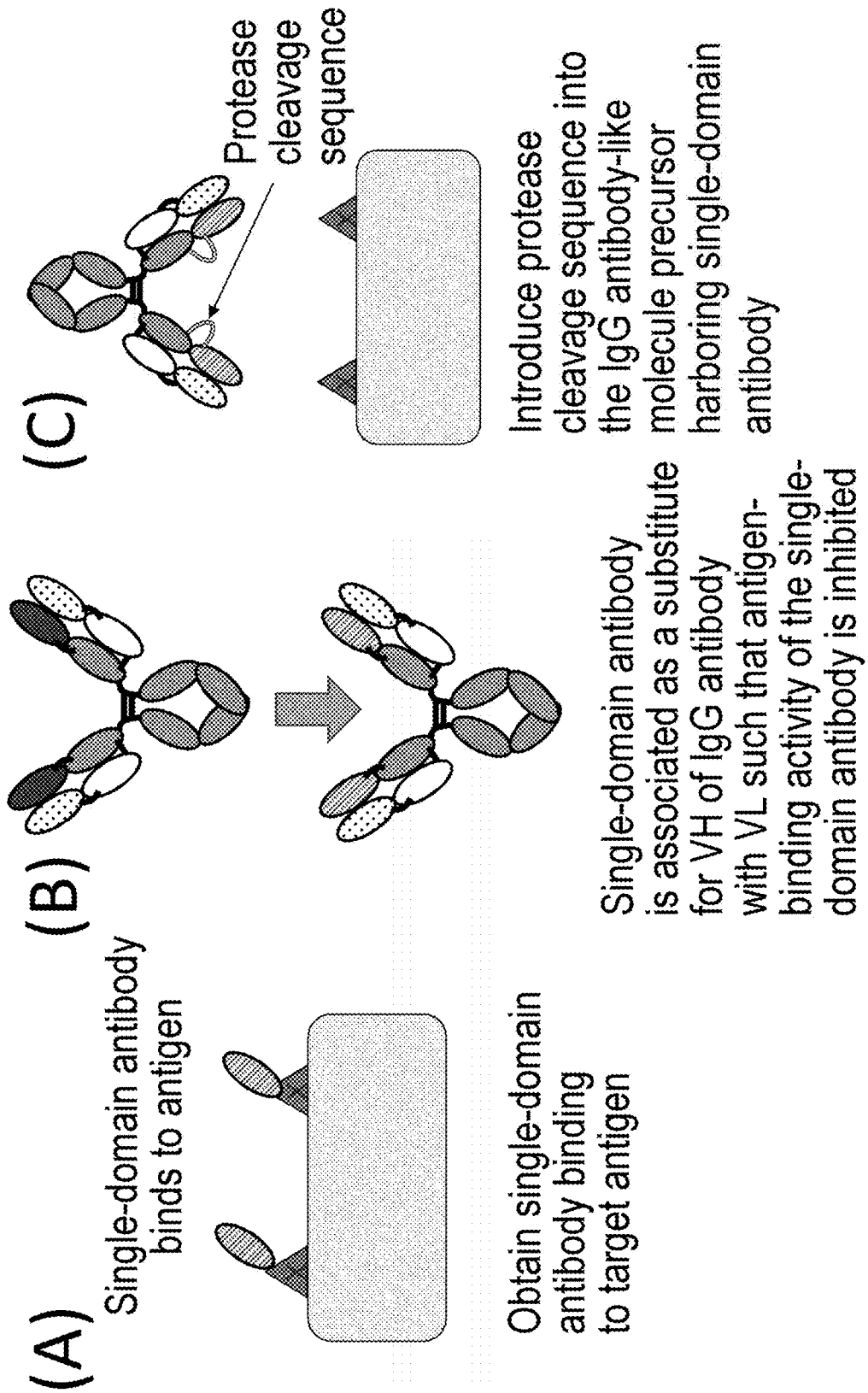
FIG. 6 is a diagram showing one embodiment of a method for producing the polypeptide of the present invention. In the present embodiment, the polypeptide of interest is an IgG antibody-like molecule. (A) A single-domain antibody binding to the target antigen is obtained. (B) The single-domain antibody is allowed to be associated with a VL as a substitute for VH of an IgG antibody such that the antigen-binding activity of the single-domain antibody is inhibited. (C) A protease cleavage sequence is introduced into an IgG antibody-like molecule precursor harboring the single-domain antibody.

The polypeptide shown in FIG. 5 has various variations. In the case of using an IgG antibody-like molecule, the polypeptide may be produced by a production method as illustrated in FIG. 6. First, a single-domain antibody (e.g., VH or VHH) binding to the target antigen is obtained (A). The obtained single-domain antibody is allowed to be associated, as a substitute for one of VH and VL of an IgG antibody having a germline sequence, with the other one (VL or VH) to form an IgG antibody-like molecule (B). A protease cleavage sequence is introduced into the IgG antibody-like molecule (C). Examples of the introduction position include a position near the boundary between the harbored single-domain antibody (VH or VHH) and the constant region (CH1 or CL).

The single-domain antibody has antigen-binding activity when existing alone, but loses its antigen-binding activity upon formation of a variable region with VL, VH, VHH, or the like. VL or VH is a native human antibody sequence having a germline sequence and therefore has a low risk of immunogenicity and is unlikely to induce an anti-drug antibody recognizing this VL or VH. In the case of forming a variable region of the single-domain antibody with VHH, the humanization of the VHH reduces the risk of immunogenicity and reduces the likelihood of inducing an anti-drug antibody recognizing this humanized VHH. The protease cleavage sequence inserted into the IgG antibody-like molecule is cleaved by protease so that the single-domain antibody is released. The released single-domain antibody has antigen-binding activity. The IgG antibody-like molecule before protease cleavage is structurally similar to general IgG molecules and therefore has long blood retention, whereas the single-domain antibody released by protease cleavage has a molecular weight of approximately 13 kDa without retaining a Fc region and therefore disappears rapidly by renal excretion. In actuality, the half-life of full-length IgG is on the order of 2 to 3 weeks (Blood. 2016 Mar. 31; 127 (13): 1633-41), whereas the half-life of the single-domain antibody is approximately 2 hours (Antibodies 2015, 4 (3), 141-156). Hence, the antigen-binding molecule activated by protease has a short half-life in blood and becomes unlikely to bind to the antigens in normal tissues.

When the single-domain antibody is VL, the same concept as above may be achieved, for example, by introducing the protease cleavage sequence to near the boundary between VL and CL.

Example 3 Preparation of Protease-Activated Polypeptide Using VHH Binding to IL-6R 3-1 Preparation of Polypeptide with Incorporated VHH Binding to IL-6R An expression vector encoding IL6R90-G1m (SEQ ID NO: 2) containing IL6R90 (SEQ ID NO: 1), VHH having binding and neutralizing activities against human IL-6R as described in WO2010/115998, fused with a human IgG1 constant region (CH1-hinge-CH2-CH3) was prepared by a method known to those skilled in the art.

Expression vectors encoding VK1-39-k0MT (SEQ ID NO: 3), VK2-28-k0MT (SEQ ID NO: 4), VK3-20-k0MT (SEQ ID NO: 5), VL1-40-1amL (SEQ ID NO: 6), VL1-44-1amL (SEQ ID NO: 7), VL2-14-1amL (SEQ ID NO: 8), VL3-21-1amL (SEQ ID NO: 9), k0 (SEQ ID NO: 10), and 1amL (SEQ ID NO: 11) as light chains (variable region-constant region) of various subclasses having a human germline sequence were prepared by a method known to those skilled in the art.

IgG antibody-like molecules IL6R90-G1m/VK1-39-k0MT (heavy chain: SEQ ID NO: 2, light chain: SEQ ID NO: 3), IL6R90-G1m/VK2-28-k0MT (heavy chain: SEQ ID NO: 2, light chain: SEQ ID NO: 4), IL6R90-G1m/VK3-20-k0MT (heavy chain: SEQ ID NO: 2, light chain: SEQ ID NO: 5), IL6R90-G1m/VL1-40-1amL (heavy chain: SEQ ID NO: 2, light chain: SEQ ID NO: 6), IL6R90-G1m/VL1-44-1amL (heavy chain: SEQ ID NO: 2, light chain: SEQ ID NO: 7), IL6R90-G1m/VL2-14-1amL (heavy chain: SEQ ID NO: 2, light chain: SEQ ID NO: 8), IL6R90-G1m/VL3-21-1amL (heavy chain: SEQ ID NO: 2, light chain: SEQ ID NO: 9), IL6R90-G1m/k0 (heavy chain: SEQ ID NO: 2, light chain: SEQ ID NO: 10), and IL6R90-G1m/1amL (heavy chain: SEQ ID NO: 2, light chain: SEQ ID NO: 11) were expressed by transient expression using FreeStyle 293 cells (Invitrogen Corp.) by a method known to those skilled in the art, and purified by a method known to those skilled in the art using protein A.

3-2 IL-6R binding evaluation of polypeptide with incorporated VHH binding to human IL-6R, IL6R90-G1m/VK1-39-k0MT, IL6R90-G1m/VK2-28-k0MT, IL6R90-G1m/VK3-20-k0MT, IL6R90-G1m/VL1-40-1amL, IL6R90-G1m/VL1-44-1amL, IL6R90-G1m/VL2-14-1amL, IL6R90-G1m/VL3-21-1amL, IL6R90-G1m/k0, and IL6R90-G1m/1amL were evaluated for their binding activity against human IL-6R by the following method.

Recombinant human IL-6R used as an antigen was prepared as follows: a CHO line stably expressing soluble human IL-6R (hereinafter, also referred to as hsIL-6R, IL6R or IL-6R) consisting of an amino acid sequence from positions 1 to 357 counted from the N terminus as reported in J. Immunol. 152, 4958-4968 (1994) was constructed by a method known to those skilled in the art, cultured, and allowed to express hsIL-6R. From the obtained culture supernatant, hsIL-6R was purified by 2 steps of Blue Sepharose 6 FF column chromatography and gel filtration column chromatography. A fraction eluted as a main peak in the final step was used as a final purified product.

Figure 10:
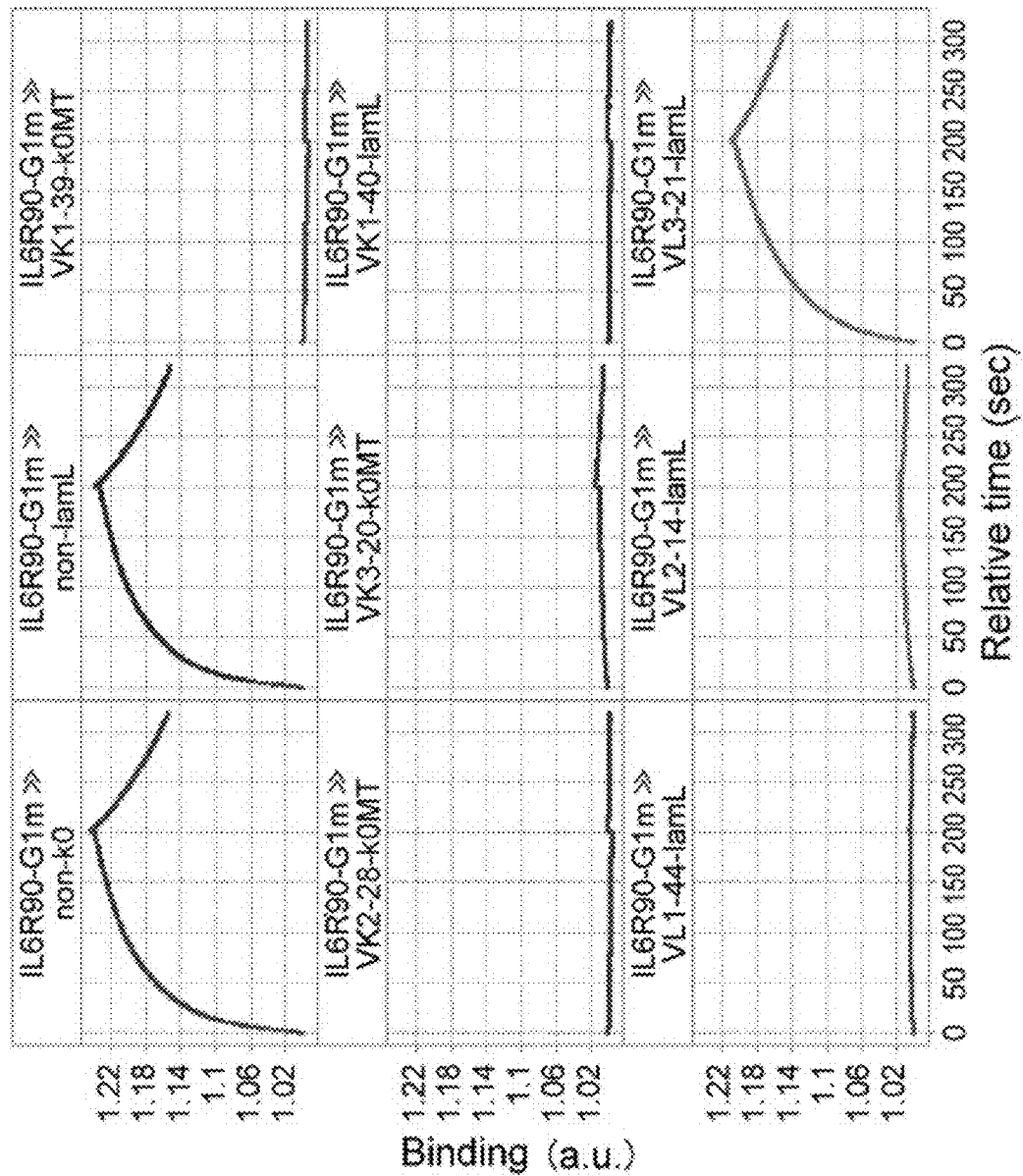
FIG. 10 is a diagram showing results of evaluating the human IL-6R binding of antibody-like molecules prepared by allowing various light chains to be associated with IL6R90-G1m containing anti-human IL-6R VHH (IL6R90) fused with a human IgG1 constant region (CH1-hinge-CH2-CH3). The time of onset of the action of the antibody-like molecules on antigen-immobilized sensors is a starting point on the abscissa.

The hsIL-6R binding evaluation of each molecule was conducted using Octet HTX (Pall ForteBio Corp.). Specifically, each molecule was allowed to bind to Biosensor/Protein A (ProA) (Pall ForteBio Corp., 18-5013), and hsIL-6R was allowed to act thereon, followed by binding evaluation at 30° C. Sensorgrams showing real time binding responses measured using Octet HTX are shown in FIG. 10. IL6R90-G1m/k0 and IL6R90-G1m/1amL lacking VL bound to hsIL-6R, whereas IL6R90-G1m/VK1-39-k0MT, IL6R90-G1m/VK2-28-k0MT, IL6R90-G1m/VK3-20-k0MT, IL6R90-G1m/VL1-40-1amL, IL6R90-G1m/VL1-44-1amL, and IL6R90-G1m/VL2-14-1amL containing a variable region formed with VL were shown to be unable to bind to hsIL-6R. From this, it was found that VHH having binding activity against human IL-6R can lose its IL-6R binding activity by forming a variable region through association with VL.

3-3 Introduction of Protease Cleavage Sequence to Polypeptide with Incorporated VHH Binding to IL-6R Study was conducted to insert a protease cleavage sequence near the boundary between the anti-human IL-6R VHH IL6R90 and CH1. Six types of heavy chains shown in FIG. 11 were designed such that peptide sequence A (SEQ ID NO: 12), a reported sequence cleavable by cancer-specifically expressed urokinase (uPA) and MT-SP1, was inserted at 3 sites near the boundary between IL6R90 and CH1 with or without a glycine-serine linker. Expression vectors encoding IL6R90H1001 (SEQ ID NO: 13), IL6R90H1002 (SEQ ID NO: 14), IL6R90H1003 (SEQ ID NO: 15), IL6R90H1004 (SEQ ID NO: 16), IL6R90H1005 (SEQ ID NO: 17), and IL6R90H1006 (SEQ ID NO: 18) were prepared by a method known to those skilled in the art.

IgG antibody-like molecules IL6R90H1001/VK1-39-k0MT (heavy chain: SEQ ID NO: 13, light chain: SEQ ID NO: 3), IL6R90H1002/VK1-39-k0MT (heavy chain: SEQ ID NO: 14, light chain: SEQ ID NO: 3), 1L6R90H1003/VK1-39-k0MT (heavy chain: SEQ ID NO: 15, light chain: SEQ ID NO: 3), IL6R90H1004/VK1-39-k0MT (heavy chain: SEQ ID NO: 16, light chain: SEQ ID NO: 3), IL6R90H1005/VK1-39-k0MT (heavy chain: SEQ ID NO: 17, light chain: SEQ ID NO: 3), and IL6R90H1006/VK1-39-k0MT (heavy chain: SEQ ID NO: 18, light chain: SEQ ID NO: 3) were expressed by transient expression using these heavy chains and VK1-39-k0MT (SEQ ID NO: 3) as light chain and using FreeStyle 293 cells (Invitrogen Corp.) by a method known to those skilled in the art, and purified by a method known to those skilled in the art using protein A.

3-4 Activation of Polypeptide Harboring Protease Cleavage Sequence by Protease Cleavage Whether IL6R90H1001/VK1-39-k0MT, IL6R90H1002/VK1-39-k0MT, IL6R90H1003/VK1-39-k0MT, IL6R90H1004NK 1-39-k0MT, IL6R90H1005/VK1-39-k0MT, and IL6R90H1006/VK1-39-k0MT would release VHH having binding activity against IL-6R by protease cleavage was verified.

Soluble human IL-6R was prepared by a method known to those skilled in the art. The prepared soluble human IL-6R was biotinylated by a method known to those skilled in the art.

For the purpose of attaching biotin to the C terminus of soluble human IL-6R (also referred to as hsIL-6R or soluble human IL-6R; SEQ ID NO: 35), a gene fragment encoding a specific sequence (AviTag sequence; SEQ ID NO: 36) to be biotinylated by biotin ligase was linked via a gene fragment encoding a linker to downstream of a gene fragment encoding hsIL-6R. A gene fragment encoding a protein containing hsIL-6R linked to the AviTag sequence (hsIL-6R-Avitag; SEQ ID NO: 37) was inserted into a vector for expression in animal cells. The constructed plasmid vector was transfected into FreeStyle 293 cells (Invitrogen Corp.) using 293Fectin (Invitrogen Corp.). In this operation, the cells were cotransfected with a gene for EBNA1 (SEQ ID NO: 57) expression and a gene for biotin ligase (BirA; SEQ ID NO: 58) expression, and biotin was further added thereto for the purpose of biotin-labeling hsIL-6R-Avitag. The cells transfected according to the procedures mentioned above were cultured at 37° C. under 8% $CO_2$ to allow secretion of the protein of interest (hsIL-6R-BAP1) into the culture supernatant. This cell culture solution was filtered through a 0.22 μm bottle-top filter to obtain a culture supernatant.

An anti-human IL-6R antibody was immobilized onto HiTrap NHS-activated HP (GE Healthcare Japan Corp.) according to the protocol of the manufacturer to prepare a column (anti-human IL-6R antibody column). The culture supernatant was applied to the anti-human IL-6R antibody column equilibrated with TBS, followed by the elution of the bound hsIL-6R with 2 M arginine (pH 4.0). Next, the eluate from the anti-human IL-6R antibody column was diluted with TBS and then applied to SoftLink Avidin column (Promega Corp.) equilibrated with TBS, followed by the elution of hsIL-6R-BAP1 with 5 mM biotin, 50 mM Tris-HCl (pH 8.0) and 2 M arginine (pH 4.0). From this eluate, aggregates of hsIL-6R-BAP1 were removed by gel filtration chromatography using Superdex 200 (GE Healthcare Japan Corp.) to obtain purified hsIL-6R-BAP1 with the buffer replaced with D-PBS and 0.05% CHAPS.

Recombinant Human Matriptase/ST14 Catalytic Domain (R&D Systems, Inc., 3946-SE-010) was used as the protease. 12.5 nM protease and 100 μg/mL of each IgG antibody-like molecule were incubated in PBS under a condition of 37° C. for 20 hours. Then, cleavage by the protease was evaluated by reducing SDS-PAGE. The results are shown in FIG. 12. As a result, the protease cleavage of the protease cleavage sequence near the boundary between the VHH and the heavy chain constant region was confirmed in IL6R90H1002/VK1-39-k0MT, IL6R90H1004/VK1-39-k0MT, IL6R90H1005/VK1-39-k0MT, and IL6R90H1006/VK1-39-k0MT.

Figure 13:
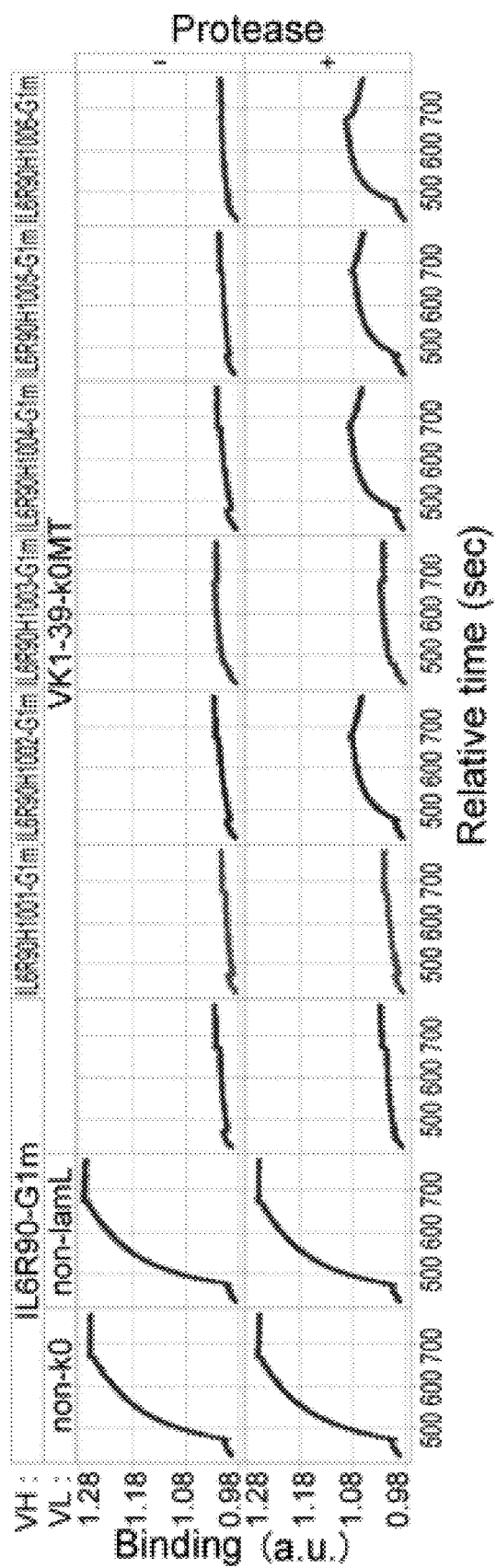
FIG. 13 is a diagram showing results of evaluating the human IL-6R binding of IL6R90-G1m or antibody-like molecules prepared by inserting a protease cleavage sequence near the boundary between VHH and the constant region in IL6R90-G1m, or these samples after protease (MT-SP1) treatment. Protease– depicts sensorgrams of evaluating the binding of the protease-untreated antibody-like molecules to the antigen, and Protease+ depicts sensorgrams of evaluating the binding of the protease-treated antibody-like molecules to the antigen. 30 seconds before onset of the action of the antibody-like molecules on antigen-immobilized sensors are a starting point on the abscissa.

Next, the IL-6R binding evaluation of VHH released by protease treatment was conducted using Octet HTX (Pall ForteBio Corp.). Specifically, hsIL-6R-BAP1 was allowed to bind to a streptavidin sensor (Pall ForteBio Corp., 18-5021), and each cleaved IgG antibody-like molecule was allowed to act thereon, followed by binding evaluation at 30° C. Sensorgrams showing real time binding responses measured using Octet HTX are shown in FIG. 13. As a result, the binding was confirmed in IL6R90H1002/VK1-39-k0MT, IL6R90H1004/VK1-39-k0MT, IL6R90H1005/VK1-39-k0MT, and IL6R90H1006/VK1-39-k0MT. IL6R90-G1m/k0 and IL6R90-G1m/1amL divalently binds with avidity, whereas the released VHH binds with affinity. Therefore, the protease-treated IL6R90H1002/VK1-39-k0MT, IL6R90H1004/VK1-39-k0MT, IL6R90H1005/VK1-39-k0MT, and 1L6R90H1006/VK1-39-k0MT exhibited a faster dissociation rate from IL-6R than that of IL6R90-G1m/k0 and IL6R90-G1m/1amL. Also, the VHH has a smaller molecular weight than that of IL6R90-G1m/k0 and IL6R90-G1m/1amL. Therefore, its response, binding amount, was lower.

These results demonstrated that IL6R90H1002/VK1-39-k0MT, IL6R90H1004/VK1-39-k0MT, IL6R90H1005/VK1-39-k0MT, or IL6R90H1006/VK1-39-k0MT does not exhibit binding activity against IL-6R as is, whereas the peptide sequence A inserted near the boundary between the VHH and the heavy chain constant region is cleaved by protease treatment so that the VHH domain is released, and the released VHH can bind to IL-6R. From this, it was concluded that the molecule conforming to the concept described in Example 2 was actually able to be prepared.

Example 4 Preparation of Protease-Activated Polypeptide by Alteration Using VHH Binding to IL-6R 4-1 IL-6R Binding Evaluation of Polypeptide with Incorporated VHH Binding to IL-6R An expression vector encoding 20A11-G1m (SEQ ID NO: 38) containing 20A11 (SEQ ID NO: 19), VHH having binding and neutralizing activities against IL-6R as described in WO2010/115998, fused with a human IgG1 constant region (CH1-hinge-CH2-CH3) in the same way as in Example 3 was prepared by a method known to those skilled in the art.

Polypeptides 20A11-G1m/VK1-39-k0MT, 20A11-G1m/VK2-28-k0MT, 20A11-G1m/VK3-20-k0MT, 20A11-G1m/VL1-40-1amL, 20A11-G1m/VL1-44-1amL, 20A11-G1m/VL2-14-1amL, and 20A11-G1m/VL3-21-1amL were expressed and purified in the same way as in Example 3 using this heavy chain and VK1-39-k0MT (SEQ ID NO: 3), VK2-28-k0MT (SEQ ID NO: 4), VK3-20-k0MT (SEQ ID NO: 5), VL1-40-1amL (SEQ ID NO: 6), VL1-44-1amL (SEQ ID NO: 7), VL2-14-1amL (SEQ ID NO: 8), and VL3-21-1amL (SEQ ID NO: 9) as light chains.

Figure 14:
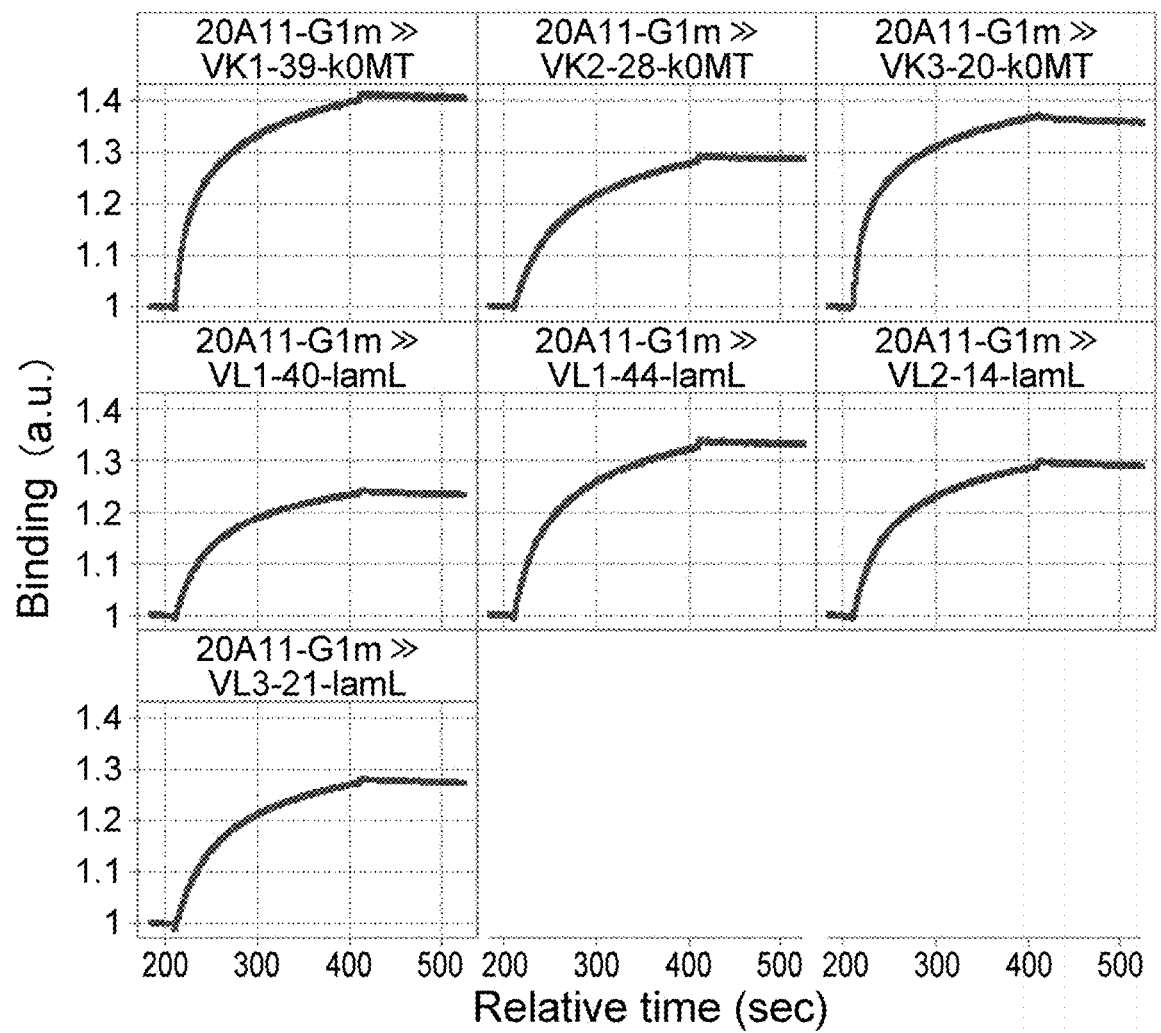
FIG. 14 is a diagram showing results of evaluating the human IL-6R binding of antibody-like molecules prepared by allowing various light chains to be associated with 20A11-G1m containing anti-human IL-6R VHH (20A11) fused with a human IgG1 constant region (CH1-hinge-CH2-CH3). 30 seconds before the time of onset of the action of the antibody-like molecules on antigen-immobilized sensors are a starting point on the abscissa.

The obtained 20A11-G1m/VK1-39-k0MT (heavy chain: SEQ ID NO: 38, light chain: SEQ ID NO: 3), 20A11-G1m/VK2-28-k0MT (heavy chain: SEQ ID NO: 38, light chain: SEQ ID NO: 4), 20A11-G1m/VK3-20-k0MT (heavy chain: SEQ ID NO: 38, light chain: SEQ ID NO: 5), 20A11-G1m/VL1-40-1amL (heavy chain: SEQ ID NO: 38, light chain: SEQ ID NO: 6), 20A11-G1m/VL1-44-1amL (heavy chain: SEQ ID NO: 38, light chain: SEQ ID NO: 7), 20A11-G1m/VL2-14-1amL (heavy chain: SEQ ID NO: 38, light chain: SEQ ID NO: 8), and 20A11-G1m/VL3-21-1amL (heavy chain: SEQ ID NO: 38, light chain: SEQ ID NO: 9) were evaluated for their binding to IL-6R in the same way as in Example 3. The results are shown in FIG. 14. As a result, none of the light chains used in this Example inhibited the IL-6R binding activity of 20A11 by the association with the heavy chain containing the 20A11 fused with the human germline IgG1 constant region (CH1-hinge-CH2-CH3).

This is probably because 20A11 did not form a stable variable region with VL used in this Example.

4-2 Introduction of Amino Acid Alteration to Interface Site Between VHH and VL in Polypeptide with Incorporated VHH not Losing Antigen Binding In order to form a stable variable region between 20A11 and VL, mutations were introduced to amino acids present at the interface between the 20A11 and the VL. An expression vector encoding 20A11 hu-G1m (SEQ ID NO: 39) containing 20A11hu (derived from 20A11 by the introduction of mutations to substitute F at position 37 with V (F37V), R at position 45 with L, and G at position 47 with W (all according to the Kabat numbering)) (SEQ ID NO: 20) fused with a human IgG1 constant region (CH1-hinge-CH2-CH3) in the same way as in Example 3 was prepared by a method known to those skilled in the art.

Polypeptides 20A11hu-G1m/VK1-39-k0MT (heavy chain: SEQ ID NO: 39, light chain: SEQ ID NO: 3), 20A11hu-G1m/VK2-28-k0MT (heavy chain: SEQ ID NO: 39, light chain: SEQ ID NO: 4), 20A11hu-G1m/VK3-20-k0MT (heavy chain: SEQ ID NO: 39, light chain: SEQ ID NO: 5), 20A11hu-G1m/VL1-40-1amL (heavy chain: SEQ ID NO: 39, light chain: SEQ ID NO: 6), 20A11hu-G1m/VL1-44-1amL (heavy chain: SEQ ID NO: 39, light chain: SEQ ID NO: 7), 20A11hu-G1m/VL2-14-1amL (heavy chain: SEQ ID NO: 39, light chain: SEQ ID NO: 8), and 20A11hu-G1m/VL3-21-1amL (heavy chain: SEQ ID NO: 39, light chain: SEQ ID NO: 9) were expressed and purified in the same way as in Example 3 using this heavy chain and VK1-39-k0MT (SEQ ID NO: 3), VK2-28-k0MT (SEQ ID NO: 4), VK3-20-k0MT (SEQ ID NO: 5), VL1-40-1amL (SEQ ID NO: 6), VL1-44-1amL (SEQ ID NO: 7), VL2-14-1amL (SEQ ID NO: 8), and VL3-21-1amL (SEQ ID NO: 9) as light chains.

Figure 15:
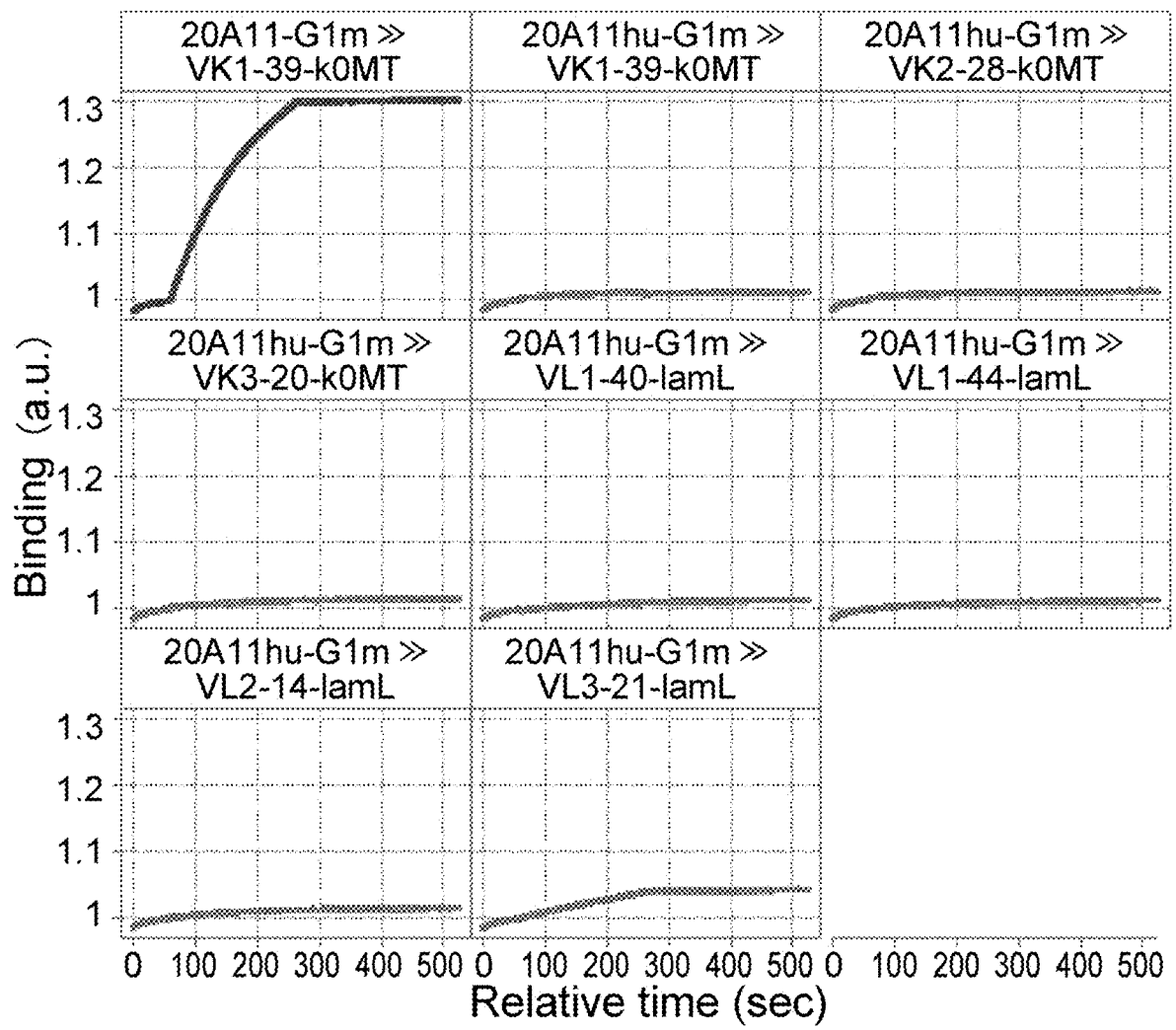
FIG. 15 is a diagram showing results of evaluating the human IL-6R binding of 20A11-G1m or antibody-like molecules prepared by introducing mutations to amino acids present at the interface between 20A11 and VL and allowing various light chains to be associated with 20A11hu-G1m containing the thus-prepared 20A11hu fused with a human IgG1 constant region (CH1-hinge-CH2-CH3). 60 seconds before the time of onset of the action of the antibody-like molecules on antigen-immobilized sensors are a starting point on the abscissa.

4-3 IL-6R Binding Evaluation of Polypeptide with Incorporated VHH Containing Amino Acid Alteration at Interface Site Between the VHH and VL The obtained 20A11hu-G1m/VK1-39-k0MT, 20A11hu-G1m/VK2-28-k0MT, 20A11hu-G1m/VK3-20-k0MT, 20A11hu-G1m/VL1-40-1amL, 20A11hu-G1m/VL1-44-1amL, 20A11hu-G1m/VL2-14-1amL, and 20A11hu-G1m/VL3-21-1amL were evaluated for their binding to IL-6R at 30° C. or 25° C. in the same way as in Example 3. The results are shown in FIG. 15.

As a result, 20A11hu-G1m/VK1-39-k0MT, 20A11hu-G1m/VK2-28-k0MT, 20A11hu-G1m/VK3-20-k0MT, 20A11hu-G1m/VL1-40-1amL, 20A11hu-G1m/VL1-44-1amL, and 20A11hu-G1m/VL2-14-1amL were shown to be unable to bind to IL-6R.

Figure 16:
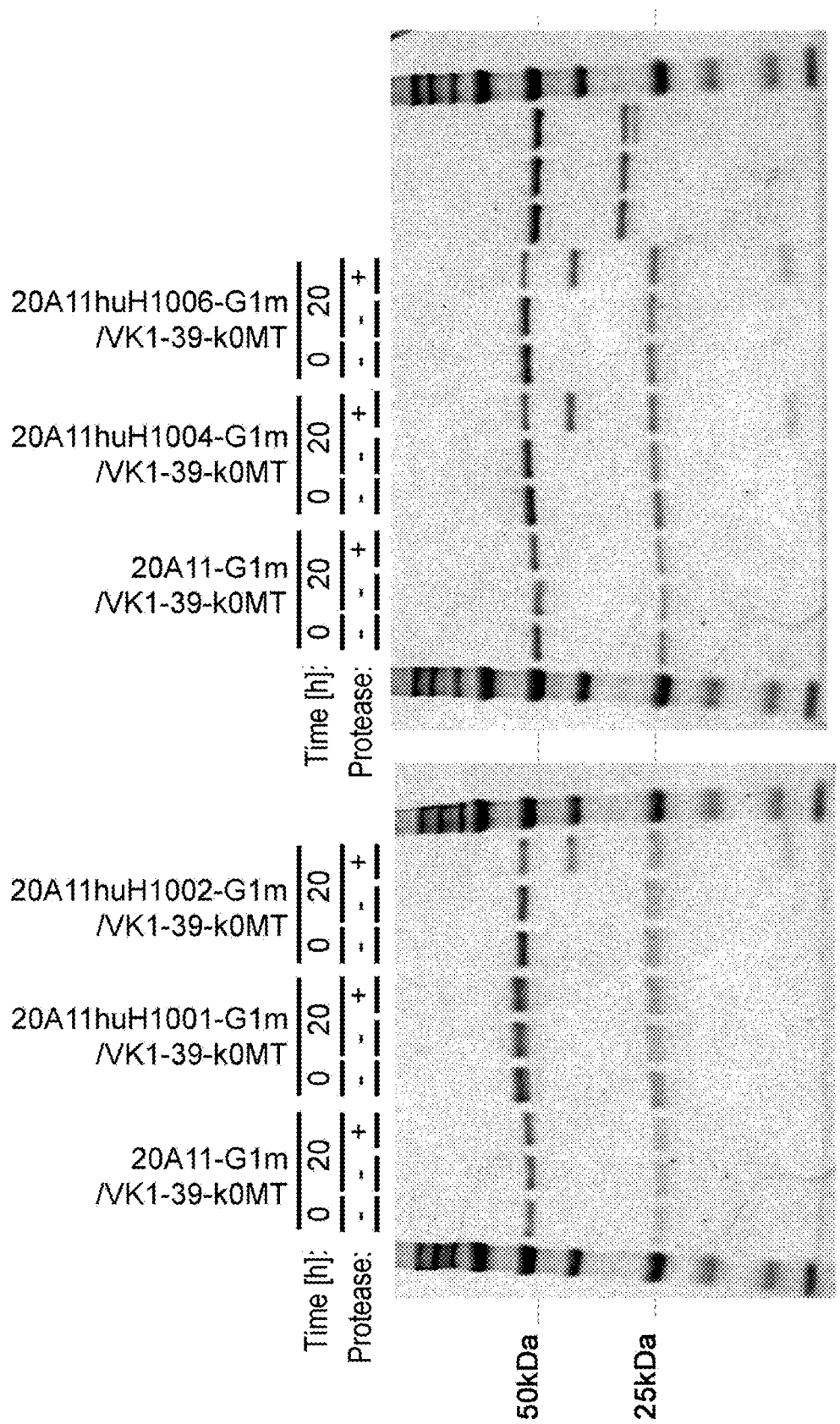
FIG. 16 is a diagram showing results of evaluating the degree of cleavage by reducing SDS-PAGE after protease (MT-SP1) treatment of 20A11-G1m or 4 types of antibody-like molecules prepared by inserting a protease cleavage sequence near the boundary between 20A11hu and the constant region in 20A11hu-G1m. Of two new bands resulting from the protease treatment, the band appearing at 25 kDa or smaller is a band derived from the VHH, and the band appearing at a position of 25 to 50 kDa is a band derived from the constant region.

These results demonstrated that the VHH 20A11, which did not lose its IL-6R binding activity by the association with VL, used in Example 3, can form a stable variable region with VL and can lose its IL-6R binding activity, by converting amino acids present at the interface site between the VHH and the VL to 37V, 45L, and 47W (Kabat numbering) and thereby altering the 20A11 to 20A11hu.

4-4 Introduction of Protease Cleavage Sequence to Polypeptide with Incorporated VHH Containing Amino Acid Alteration at Interface Site Between the VHH and VL Heavy chains 20A11huH1001 (SEQ ID NO: 40), 20A11huH1002 (SEQ ID NO: 41), 20A11huH1004 (SEQ ID NO: 42), and 20A11huH1006 (SEQ ID NO: 43) were prepared in the same way as in Example 3 such that a protease cleavage sequence (SEQ ID NO: 12) or a protease cleavage sequence linked to a flexible linker (SEQ ID NO: 44) was inserted near the boundary between 20A11hu and CH1.

Polypeptides 20A11huH1001/VK1-39-k0MT (heavy chain: SEQ ID NO: 40, light chain: SEQ ID NO: 3), 20A11huH1002/VK1-39-k0MT (heavy chain: SEQ ID NO: 41, light chain: SEQ ID NO: 3), 20A11huH1004/VK1-39-k0MT (heavy chain: SEQ ID NO: 42, light chain: SEQ ID NO: 3), and 20A11huH1006/VK1-39-k0MT (heavy chain: SEQ ID NO: 43, light chain: SEQ ID NO: 3) were expressed and purified in the same way as in Example 3 using these heavy chains and VK1-39-k0MT (SEQ ID NO: 3) as a light chain.

4-5 Activation of Polypeptide Harboring Protease Cleavage Sequence by Protease Cleavage 20A11huH1001/VK1-39-k0MT, 20A1 huH1002/VK1-39-k0MT, 20A11huH1004/VK1-39-k0MT, and 20A11huH1006/VK1-39-k0MT were cleaved by protease in the same way as in Example 3, and the degree of the cleavage was evaluated by reducing SDS-PAGE. The results are shown in FIG. 16.

As a result, 20A11huH1002/VK1-39-k0MT, 20A11 huH1004/VK1-39-k0MT, and 20A11huH1006/VK1-39-k0MT were confirmed to undergo protease cleavage near the boundary between VHH and CH1.

Figure 17:
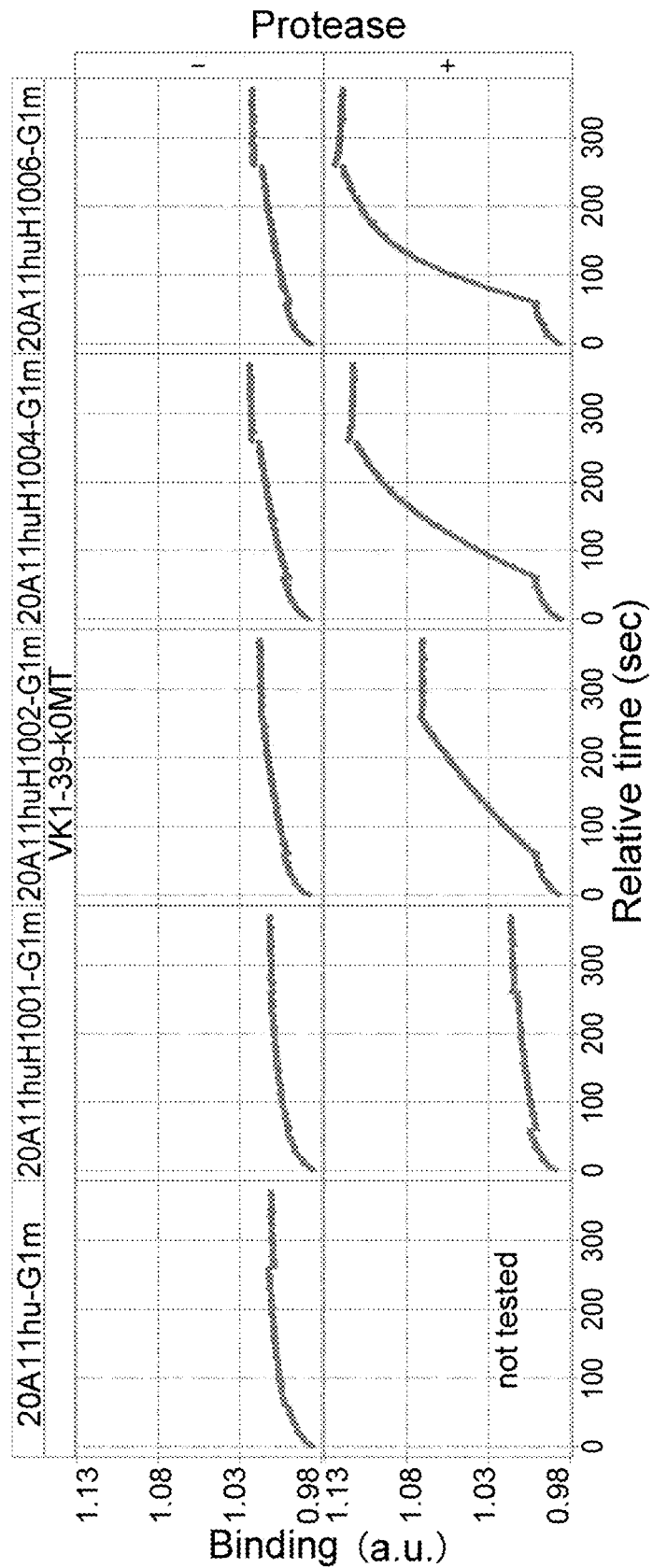
FIG. 17 is a diagram showing results of evaluating the human IL-6R binding of 20A11-G1m or antibody-like molecules prepared by inserting a protease cleavage sequence near the boundary between VHH and the constant region in 20A11hu-G1m, or these samples after protease (MT-SP1) treatment. Protease– depicts sensorgrams of evaluating the binding of the protease-untreated antibody-like molecules to the antigen, and Protease+ depicts sensorgrams of evaluating the binding of the protease-treated antibody-like molecules to the antigen. 60 seconds before onset of the action of the antibodies on antigen-immobilized sensors are a starting point on the abscissa. The sample with the term "not tested" represents that the sample was not assayed.

Next, the IL-6R binding evaluation of VHH released by protease treatment was conducted at 30° C. or 25° C. in the same way as in Example 3. Octet sensorgrams are shown in FIG. 17.

As a result, the IL-6R binding was confirmed in 20A11huH1002/VK1-39-k0MT, 20A11huH1004/VK1-39-k0MT, and 20A1I huH1006/VK1-39-k0MT confirmed to undergo cleavage near the boundary between VHH and CH1 by protease treatment.

These results demonstrated that even if VHH incorporated into a polypeptide does not lose its antigen-binding activity immediately after association with particular VL, the antigen-binding activity can be lost by introducing an association promoting mutation into an amino acid present at the interface between the VHH and the VL.

From these results, it was concluded that the molecule conforming to the concept described in Example 2 can also be prepared by a method of combining a light chain with VHH containing a substituted amino acid involved in association with the light chain, in addition to the method of combining a light chain with VHH obtained in advance as in Example 3.

Example 5 Preparation of Protease-Activated Polypeptide Using VHH Derived from Immunized Alpaca 5-1 Obtainment of VHH Derived from Immunized Alpaca Alpacas were immunized with IL-6R, CD3 or Plexin A1 by a method known to those skilled in the art. 4 and 8 weeks later, PBMCs were collected. From the collected PBMCs, VHH gene was amplified with reference to a method described in J. Immunol. Methods (2007) 324, 13. The amplified VHH gene fragment was connected with gene 3 gene and inserted into a phagemid vector. The phagemid vector having the insert of the VHH fragment was transfected into E. coli by the electroporation method, and phages presenting VHH were obtained by a method already known to those skilled in the art. The obtained phages were evaluated for their binding to IL-6R, CD3 or Plexin A1 by ELISA. The sequence of a bound clone was analyzed by a method known to those skilled in the art to identify VHH binding to the antigen.

5-2 Enrichment of VHH Binding to CD3

VHH binding to human CD3 was identified from the VHH library constructed in Example 5-1. VHH clones having binding capacity against human CD3 were enriched using a biotin-labeled protein containing human CD3E and human CD36 linked to a human antibody constant region (human CD3ed-Fc) as an antigen. The human CD3ed-Fc was prepared as follows: an expression vector for animal cells having a gene encoding the amino acid sequence represented by SEQ ID NO: 59, a gene encoding the amino acid sequence represented by SEQ ID NO: 60 and a gene encoding BirA (SEQ ID NO: 58) was transfected into FreeStyle 293 cells (Invitrogen Corp.). After the transfection, L-biotin was added thereto, and biotinylation was carried out in a culture solution. Cell culture was performed by shake culture at 37° C. according to the protocol. 4 to 5 days later, the supernatant was collected. From the supernatant, a protein fused with the antibody constant region was obtained using a protein A column (Eshmuno A (Merck KGaA)). For the purpose of further obtaining only a CD3e8 heterodimer, a fraction of the CD3E8 heterodimer fused with the antibody constant region (referred to as human CD3ed-Fc) was separated using Anti-FLAG M2 column. Subsequently, gel filtration chromatography (Superdex 200, GE Healthcare Japan Corp.) was carried out to obtain the fraction of the CD3E8 heterodimer of interest (referred to as human CD3ed-Fc).

Phage production was performed from E. coli retaining the constructed phagemids for phage display. A phage population was precipitated by the addition of 2.5 M NaCl/10% PEG to the culture solution of the E. coli after the phage production, and then diluted with TBS to obtain a phage library solution. Next, BSA was added to the phage library solution so as to attain a final BSA concentration of 4%. Panning was performed with reference to a general panning method using an antigen immobilized onto magnetic beads (J. Immunol. Methods. (2008) 332 (1-2), 2-9; J. Immunol. Methods. (2001) 247 (1-2), 191-203; Biotechnol. Prog. (2002) 18 (2) 212-20; and Mol. Cell Proteomics (2003) 2 (2), 61-9). The magnetic beads used were NeutrAvidin coated beads (FG beads NeutrAvidin) or Streptavidin coated beads (Dynabeads MyOne Streptavidin Ti).

Specifically, 100 pmol of the biotin-labeled antigen was added to the prepared phage library solution, and the phage library solution was contacted with the antigen at room temperature for 60 minutes. The magnetic beads blocked with BSA were added thereto, and the complexes of the antigen and the phages were allowed to bind to the magnetic beads at room temperature for 15 minutes. The beads were washed twice with 0.5 mL of TBST (TBS containing 0.1% Tween 20; TBS was manufactured by Takara Bio Inc.) and then further washed once with 0.5 mL of TBS. Then, 0.5 mL of 1 mg/mL trypsin was added thereto, and the beads were suspended at room temperature for 15 minutes and immediately thereafter, separated using a magnetic stand to recover a phage solution. The recovered phage solution was added to 20 mL of an E. coli strain ER2738 in an exponential stage of growth (OD600: 0.4-0.5). The E. coli was cultured with mild stirring at 37° C. for 1 hour and thereby infected by the phages. The infected E. coli was inoculated to a 225 mm×225 mm plate. Next, the phages were recovered from the culture solution of the inoculated E. coli to prepare a phage library solution. This cycle, called panning, was repeated twice in total. In the second cycle of panning, the beads were washed three times with TBST and subsequently twice with TBS. Also, 4 nmol of human Fc was added in the case of the panning against the human CD3ed-Fc.

5-3 Preparation of Protease-Activated IgG Antibody-Like Molecule with Incorporated VHH Binding to CD3

A nucleotide sequence encoding the VHH sequence (Table 2) of each binding clone for human CD3 obtained in Example 5-1 or 5-2 was connected to a nucleotide sequence encoding a protease cleavage site and a constant region by the method described in Example 3 and inserted into an expression vector for animal cells. The resultant was used as the heavy chain of an IgG antibody-like molecule.

Table 2

TABLE 2

VHH Binding to Human CD3

| VHH | SEQ ID NO |
|---|---|
| bC3edL1R1N160H01 | 61 |
| bC3edL1R1N161H01 | 62 |
| bC3edL1R1N164H01 | 63 |

Protease-activated IgG antibody-like molecules shown in Table 3 below were expressed by transient expression using FreeStyle 293 cells (Invitrogen Corp.) by a method known to those skilled in the art, and purified by a method known to those skilled in the art using protein A.

TABLE 3

Protease-activated IgG Antibody-like Molecules with an Incorporated VHH that Binds to CD3

| IgG antibody-like molecule | SEQ ID NO of heavy chain | SEQ ID NO of light chain |
|---|---|---|
| bC3edL1R1N160H01-G1mISHI01/ VK1-39-k0MT | 64 | 3 |
| bC3edL1R1N161H01-G1mISHI01/ VK1-39-k0MT | 65 | |
| bC3edL1R1N164H01-G1mISHI01/ VK1-39-k0MT | 66 | |

Figure 18:
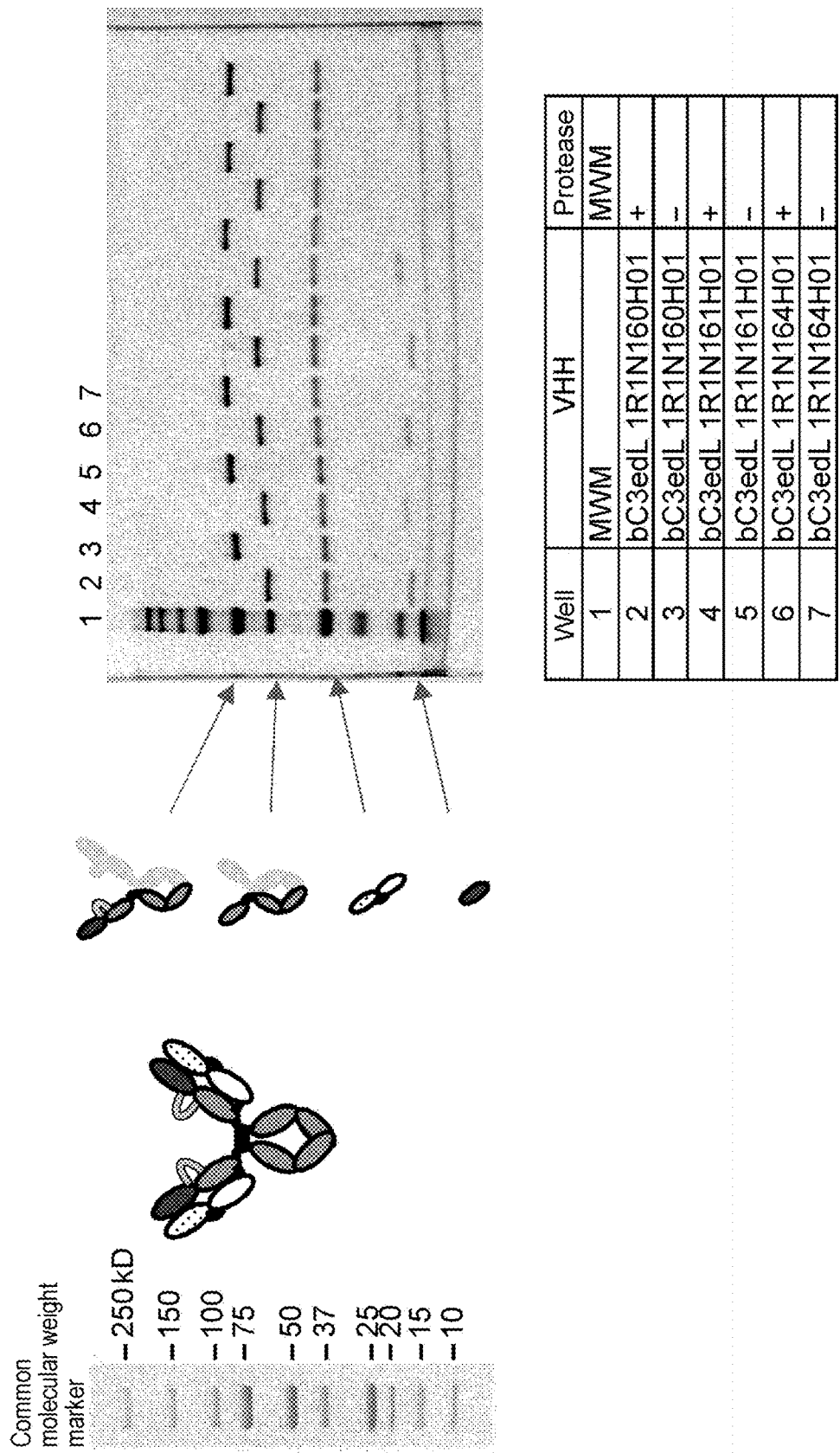
FIG. 18 is a diagram showing results of evaluating the degree of cleavage by subjecting to electrophoresis in reducing SDS-PAGE and detection with CBB after protease (MT-SP1) treatment of antibody-like molecules that had anti-human CD3 VHH in their heavy chain variable regions and were prepared by inserting a protease cleavage sequence near the boundary between the VHH and the heavy chain constant region. Of two new bands resulting from the protease treatment, the band appearing around 10 to 15 kDa is a band derived from the VHH, and the band appearing around 37 kDa is a band derived from the heavy chain constant region.

5-4 Activation of Protease-Activated IgG Antibody-Like Molecules by Protease Cleavage The IgG antibody-like molecules prepared in Example 5-3 were cleaved by protease in the same way as in Example 3, and the degree of the cleavage was evaluated by reducing SDS-PAGE. The results are shown in FIG. 18. The protease concentration was set to 25 nM, and Octet RED (Pall ForteBio Corp.) was used in the assay.

As a result, the IgG antibody-like molecules were confirmed to undergo protease cleavage at the protease cleavage sequence.

Figure 19:
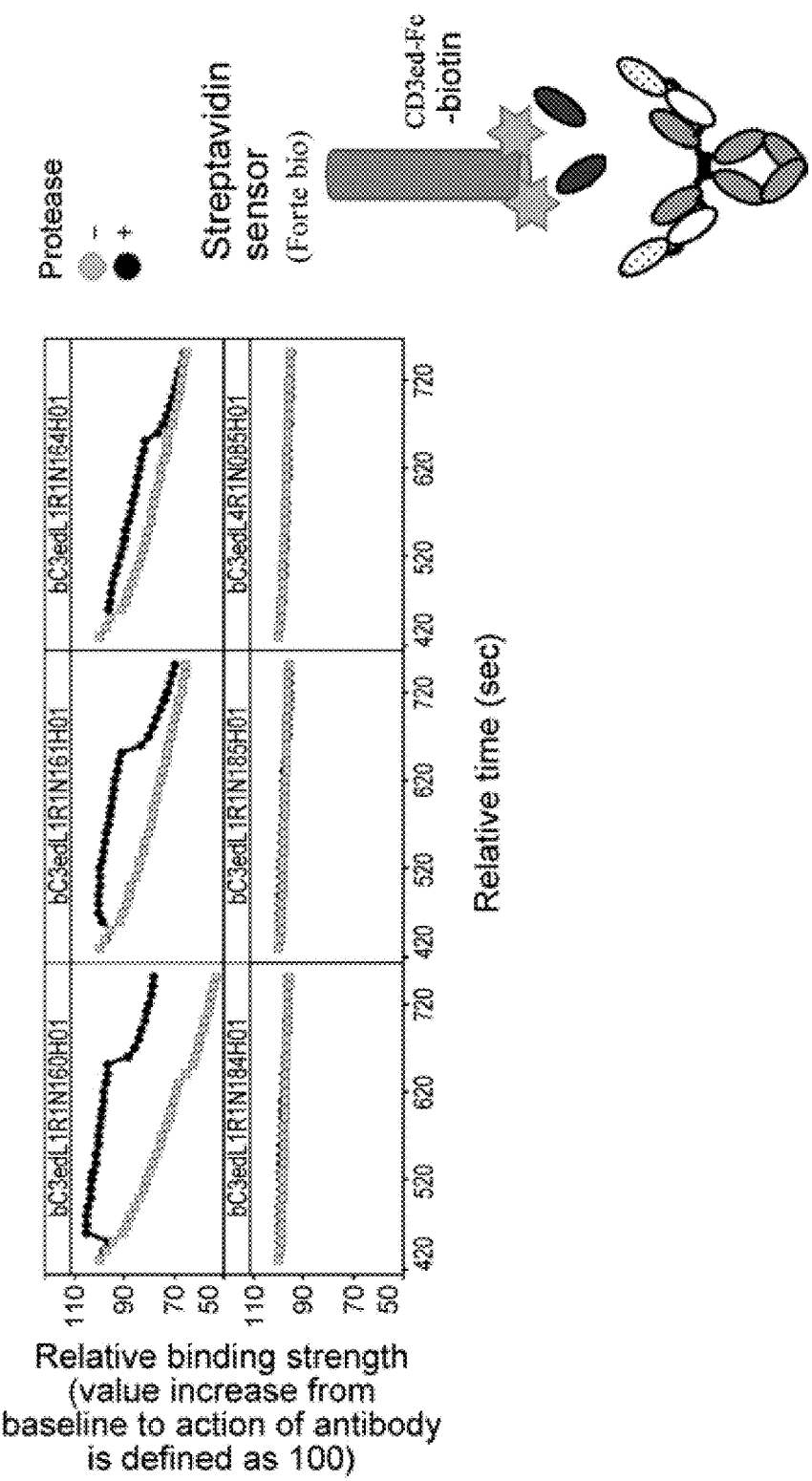
FIG. 19 is a diagram showing results of evaluating the human CD3ed-Fc binding of samples after protease (MT- SP1) treatment of antibody-like molecules that had anti-human CD3 VHH in their heavy chain variable regions and were prepared by inserting a protease cleavage sequence near the boundary between the VHH and the heavy chain constant region. Protease– depicts sensorgrams of evaluating the binding of the protease-untreated antibody-like molecules to the antigen, and Protease+ depicts sensorgrams of evaluating the binding of the protease-treated antibody-like molecules to the antigen. 30 seconds before onset of the action of the antibody-like molecules on antigen-immobilized sensors are a starting point on the abscissa. The binding is shown when a response before antigen binding was defined as 0 and a response before action of the antibodies was defined as 100. The time starting at 30 seconds before action of the antibodies is shown.

Next, the CD3 binding evaluation of VHH released by protease treatment was conducted in the same way as in Example 3. Octet sensorgrams are shown in FIG. 19.

As a result, the IgG antibody-like molecules bC3edL1R1N160H01-G1mISHI10/VK1-39-k0MT, bC3edL1R1N161H01-G1mISHI01/VK1-39-k0MT, and bC3edL1R1N164H01-G1mISHI01/VK1-39-k0MT did not exhibit antigen binding before the protease treatment, whereas the antigen binding was confirmed after the protease treatment. Plurality of VHH binding to CD3 molecules, obtained in the same way as in the VHH described in Table 2, was also used to prepare an IgG-like molecule containing the same protease cleavage site as in the IgG antibody-like molecules described in Table 3. As a result, the antigen binding was confirmed by protease treatment. These results demonstrated that in addition to the polypeptides shown in Examples 3 and 4, an IgG antibody-like molecule harboring a protease cleavage sequence can undergo cleavage at the protease cleavage sequence by protease treatment and thereby release the antigen-binding domain, and the released antigen-binding domain can bind to the antigen.

Example 6 Polypeptide Harboring Protease Cleavage Sequence in its Light Chain

Light chains VK1-39P-2-Pk0MT (SEQ ID NO: 67), VK1-39P-1-Pk0MT (SEQ ID NO: 68), VK1-39P-Pk0MT (SEQ ID NO: 69), VK1-39P+2-Pk0MT (SEQ ID NO: 70), VK1-39P+3-Pk0MT (SEQ ID NO: 71), VK1-39P+4-Pk0MT (SEQ ID NO: 72), and VK1-39P+5-Pk0MT (SEQ ID NO: 73) harboring a protease cleavage sequence at each position were prepared in the same way as in Example 3.

IgG antibody-like molecules were expressed and purified in the same way as in Example 3 using these light chains and IL6R90-G1m (SEQ ID NO: 2) as a heavy chain. The protease concentration was set to 25 nM. IL6R90-G1m/ VK1-39-k0MT (heavy chain: SEQ ID NO: 2, light chain: SEQ ID NO: 3) was used as an IgG antibody-like molecule harboring no cleavage sequence.

Figure 20:
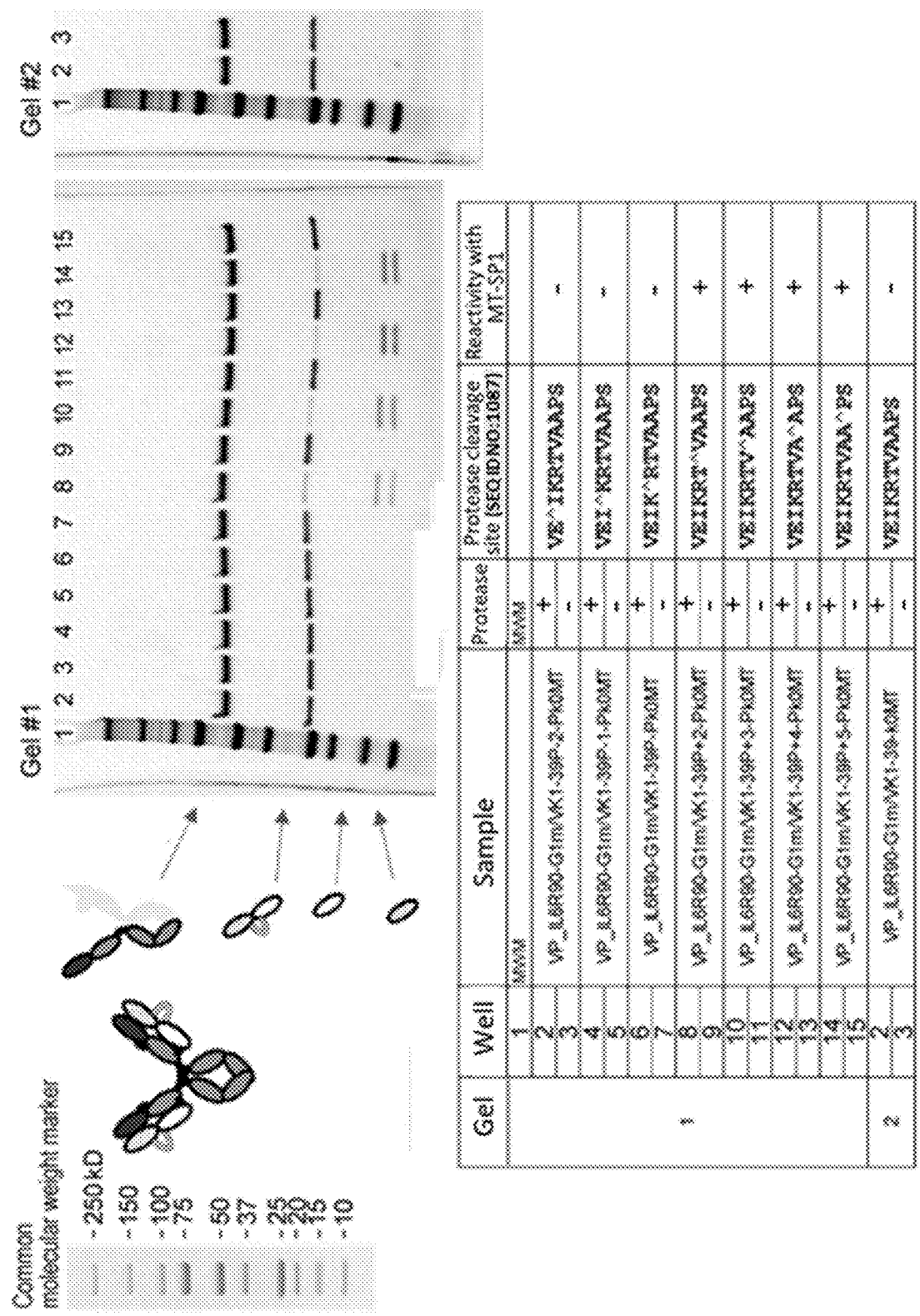
FIG. 20 is a diagram showing results of evaluating the degree of cleavage by subjecting to electrophoresis in reducing SDS-PAGE and detection with CBB after protease (MT-SP1) treatment of a molecule having IL6R90-G1m as a heavy chain and Vk1-39-k0MT as a light chain, or antibody-like molecules prepared by inserting a protease cleavage sequence near the boundary between the light chain variable region and the light chain constant region of the molecule having IL6R90-G1m as a heavy chain and Vk1-39-k0MT as a light chain. Two bands derived from the light chain resulted from the protease treatment, and the light chain was cleaved by protease.
Figure 21:
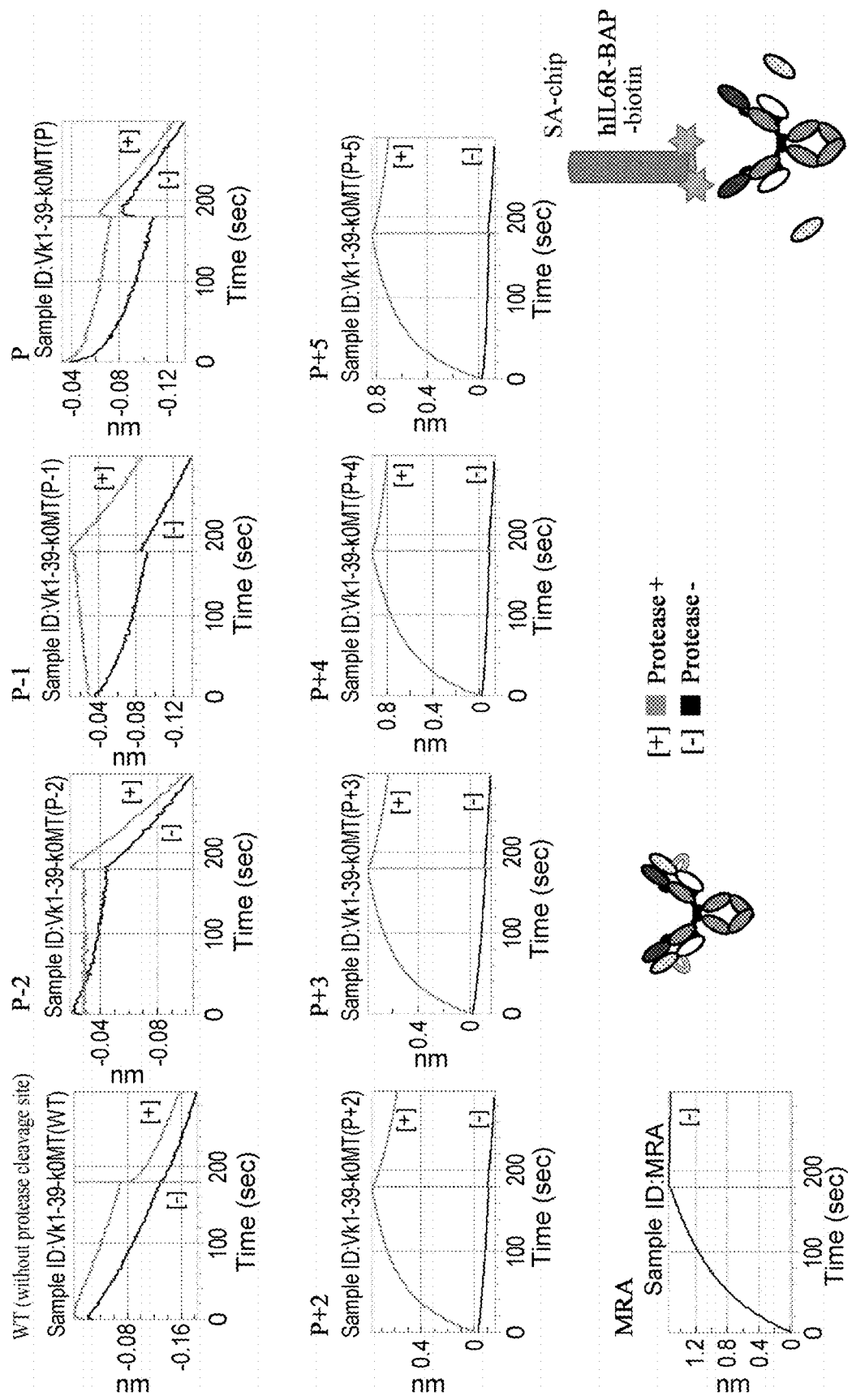
FIG. 21 is a diagram showing results of evaluating the human IL-6R binding of samples after protease (MT-SP1) treatment of a molecule having IL6R90-G1m as a heavy chain and Vk1-39-k0MT as a light chain, or antibody-like molecules prepared by inserting a protease cleavage sequence near the boundary between the light chain variable region and the light chain constant region of the molecule having IL6R90-G1m as a heavy chain and Vk1-39-k0MT as a light chain. Protease– depicts sensorgrams of evaluating the binding of the protease-untreated antibody-like molecules to the antigen, and Protease+ depicts sensorgrams of evaluating the binding of the protease-treated antibody-like molecules to the antigen. An antibody (MRA) confirmed to bind to IL-6R was used as a positive control. The time of onset of the action of the antibody-like molecules on antigen-immobilized sensors is a starting point on the abscissa.
Figure 22:
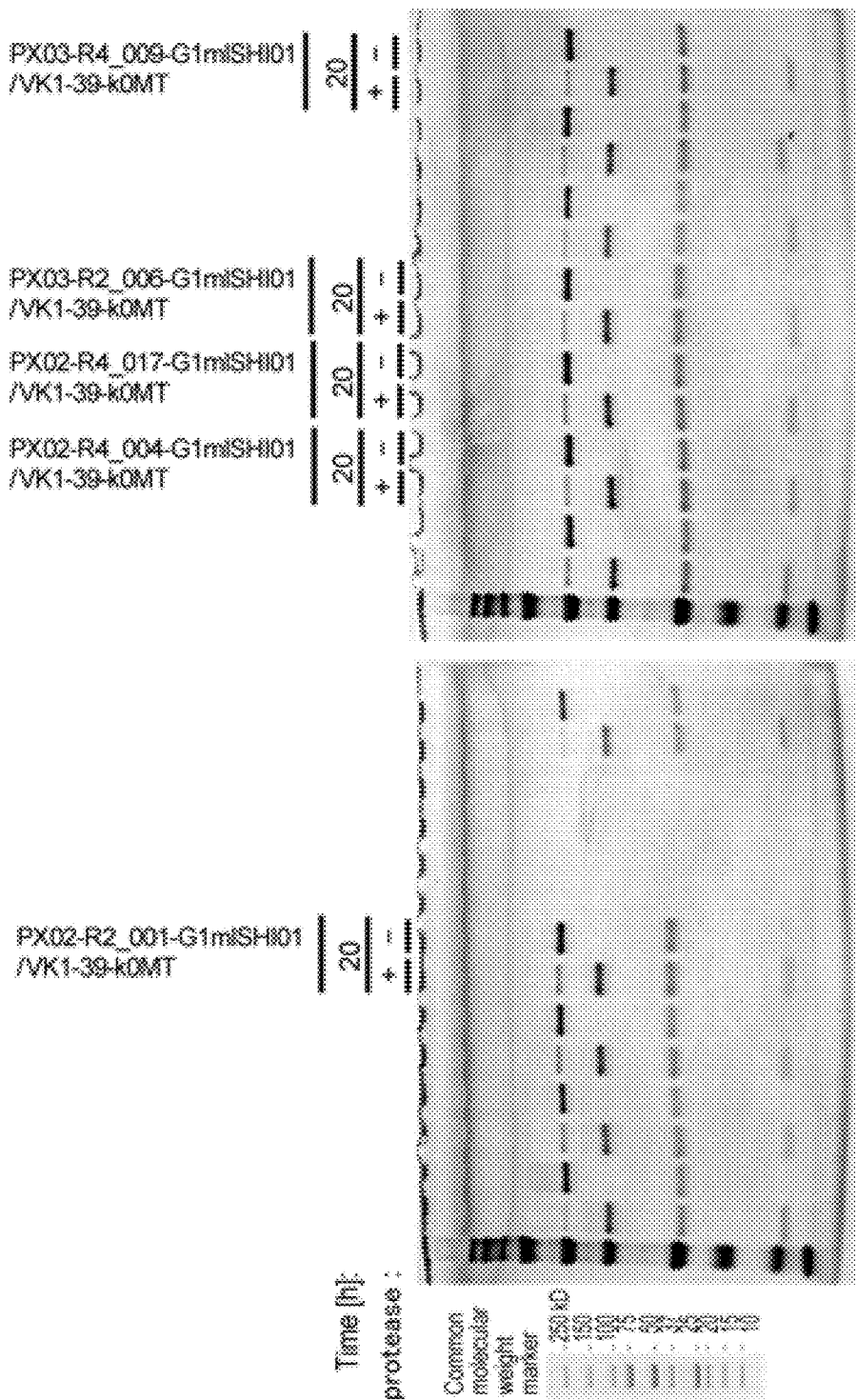
FIG. 22 is a diagram showing SDS-PAGE results of evaluating the protease cleavage of IgG antibody-like molecules with incorporated VHH binding to human Plexin A1. Protease(+) lane depicts samples treated by protease cleavage, and protease(−) lane depicts negative control samples without the protease cleavage treatment.
Figure 23:
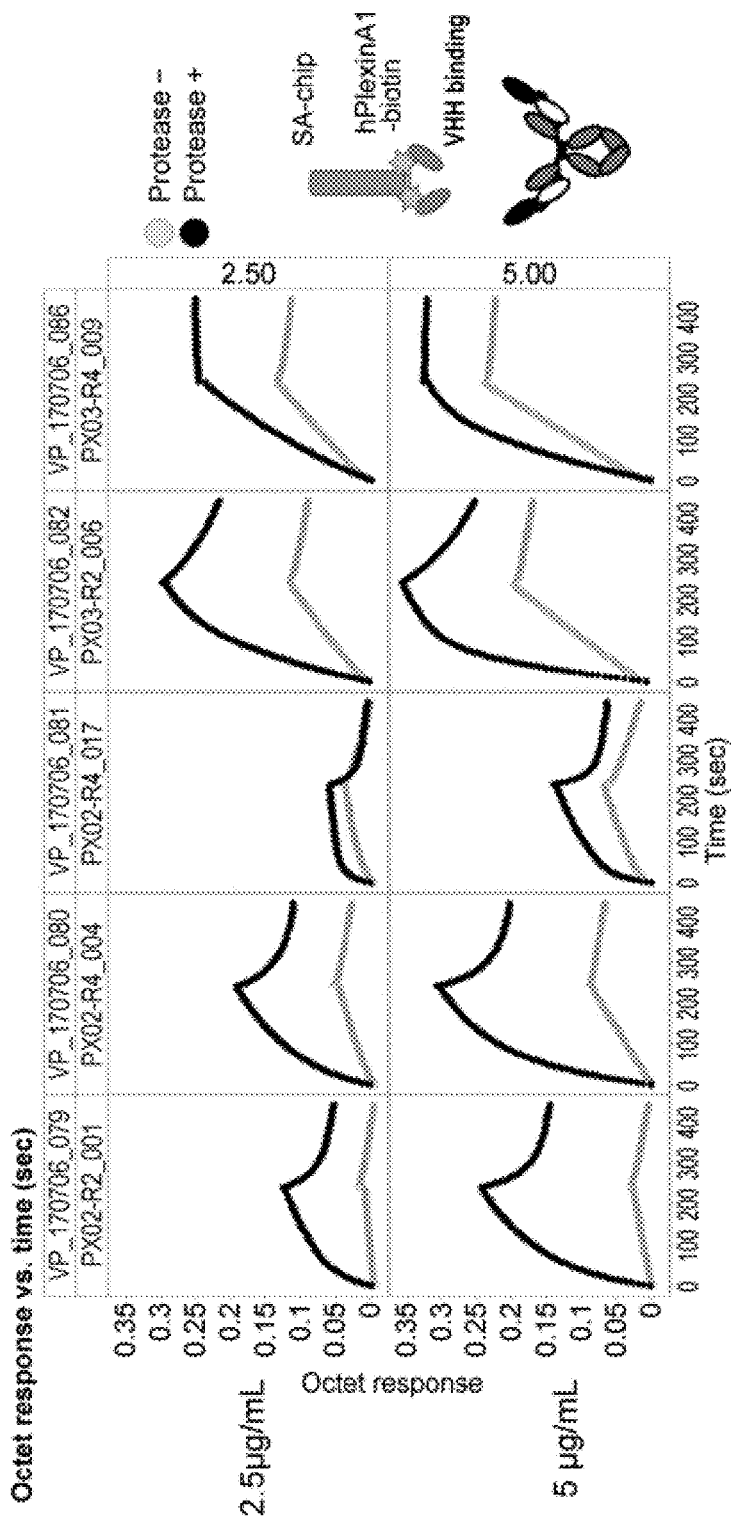
FIG. 23 is a diagram showing Octet sensorgrams of evaluating the human Plexin A1 binding of VHH released by protease cleavage from IgG antibody-like molecules with incorporated VHH binding to human Plexin A1. Protease+ depicts samples treated by protease cleavage, and protease– depicts samples without the protease cleavage treatment. The concentrations of the IgG antibody-like molecules used are described on the left side of the diagram.

Subsequently, the prepared IgG antibody-like molecules were cleaved by protease in the same way as in Example 3, and the degree of the cleavage was evaluated by reducing SDS-PAGE. The results are shown in FIG. 20. As a result, VK1-39P+2-Pk0MT (SEQ ID NO: 70), VK1-39P+3-Pk0MT (SEQ ID NO: 71), VK1-39P+4-Pk0MT (SEQ ID NO: 72), and VK1-39P+5-Pk0MT (SEQ ID NO: 73) were confirmed to undergo protease cleavage at the protease cleavage sequence. The IL-6R binding evaluation of VHH exposed by protease treatment was further conducted in the same way as in Example 3. Octet sensorgrams are shown in FIG. 21. As a result, the binding was also confirmed by the protease treatment of the cleavage sequence introduced into the light chain, demonstrating that a protease-activated polypeptide harboring a protease cleavage sequence in its light chain can be obtained such that the antigen-binding domain is exposed to exhibit antigen-binding ability by the protease cleavage of the light chain.

Example 7 Library Containing Heavy Chain Having Antigen-Binding Domain and Light Chain Harboring Protease Cleavage Sequence, and Obtainment of Protease-Activated Polypeptide by Phage Display Method from the Library As confirmed in Example 6, even when a protease cleavage sequence is introduced into the light chain of a protease-activated polypeptide, the antigen-binding domain is exposed after cleavage of the light chain to bind to the antigen.

Accordingly, a heavy chain containing an antigen-binding domain such as a single-domain antibody and a light chain harboring a protease cleavage sequence are incorporated into a phagemid and allowed to be presented by a phage. A plurality of phagemids for phage display containing different types of antigen-binding domains are constructed, followed by phage production from *E. coli* retaining these phagemids. A phage population is precipitated by the addition of 2.5 M NaCl/10% PEG to the culture solution of the *E. coli* after the phage production, and then diluted with TBS to obtain a phage library solution. BSA is added to the phage library solution so as to attain a final BSA concentration of 4%.

The protease-activated polypeptide is obtained by panning from the phage library thus prepared. The panning is performed with reference to a general panning method using an antigen immobilized on magnetic beads (J. Immunol. Methods. (2008) 332 (1-2), 2-9; J. Immunol. Methods. (2001) 247 (1-2), 191-203; Biotechnol. Prog. (2002) 18 (2) 212-20; and Mol. Cell Proteomics (2003) 2 (2), 61-9). Phages unbound with the antigen-immobilized magnetic beads are recovered before addition of protease, and phages bound with the antigen-immobilized magnetic beads are recovered after addition of protease. The magnetic beads used are NeutrAvidin coated beads (Sera-Mag SpeedBeads NeutrAvidin-coated, FG beads NeutrAvidin) or Streptavidin coated beads (Dynabeads M-280 Streptavidin). An antigen-binding clone may be selected from the recovered phages by phage ELISA described in the preceding section, or the antibody gene is subcloned into a vector for expression in animals and expressed using animal cells, and the binding activity is compared between before and after protease treatment to select binding clones.

Example 8 Library Containing Heavy Chain Having Antigen-Binding Domain and Light Chain, and Obtainment of Heavy Chain Whose Antigen-Binding Ability is Controlled by Light Chain by Phage Display Method from the Library As confirmed in Example 3, the antigen-binding ability of a heavy chain containing an antigen-binding domain is controlled by the association of a light chain. Accordingly, a heavy chain that loses its antigen-binding ability when associated with a light chain and exhibits antigen-binding ability when presented alone or in combination with a light chain constant region is obtained by the phage display method.

A heavy chain containing an antigen-binding domain such as a single-domain antibody is incorporated in a phagemid and presented by a phage. A plurality of phagemids for phage display containing different types of antigen-binding domains are constructed, followed by phage production from E. coli retaining these phagemids. A phage population is precipitated by the addition of 2.5 M NaCl/10% PEG to the culture solution of the E. coli after the phage production, and then diluted with TBS to obtain a phage library solution. BSA is added to the phage library solution so as to attain a final BSA concentration of 4%.

The heavy chain that exhibits antigen-binding ability when presented alone or in combination with a light chain constant region and loses its antigen-binding ability when associated with the light chain variable region is obtained by panning from the phage library thus prepared. The panning is performed with reference to the panning method using an antigen immobilized onto magnetic beads described in Example 5. Phages bound with the antigen-immobilized magnetic beads are recovered from the phage library presenting heavy chains or heavy chains with light chain constant regions. The recovered phages are allowed to infect E. coli, and phages presenting heavy and light chains are produced using a helper phage expressing a light chain. Phages presenting a heavy chain containing an antigen-binding domain and a light chain are obtained by the method mentioned above from the culture solution of the E. coli after the phage production. Phages unbound with the antigen-immobilized magnetic beads are recovered from the population of phages presenting heavy and light chains.

As shown in FIG. 9D, the panning may be carried out by changing the order of the recovery of a phage population presenting a heavy chain, either alone or in combination with a light chain constant region, binding to antigen-immobilized magnetic beads, and the recovery of a phage population presenting heavy and light chains without binding to antigen-immobilized magnetic beads. In addition to the method of expressing a light chain using a helper phage, a region encoding a light chain and a region encoding a heavy chain may be incorporated to the same phagemid as usual, and a gene encoding only a light chain constant region or a full-length light chain may be incorporated into each cycle of panning and used.

An antigen-binding clone may be selected from the recovered phages by phage ELISA described in the preceding section, or the antibody gene is subcloned into a vector for expression in animals and expressed using animal cells, and the binding activity is compared between before and after protease treatment to select binding clones.

Example 9 Obtainment of VHH Whose Antigen-Binding Ability is Controlled by Light Chain by Use of Phage Display Method, and Preparation of IgG Antibody-Like Molecule Containing the VHH In Example 3, it was confirmed that the antigen-binding ability of VHH contained as a substitute for VH in a heavy chain is controlled by association with a light chain. Accordingly, VHH that lost its antigen-binding ability when associated with a particular light chain and exhibited antigen-binding ability when the heavy chain was presented alone or in combination with a light chain constant region, i.e., when not associated with a light chain variable region, was obtained from a phage library presenting CH1 linked to VHH derived from immunized alpaca PBMCs. An IgG antibody-like molecule containing the VHH was prepared.

9-1 Construction of Light Chain-Expressing Helper Phages with Integrated Light Chain Expression Unit On the basis of a method described in WO2015/046554, a promoter, a signal sequence, antibody light chain variable region and light chain constant region genes or a light chain constant region gene, etc. were integrated into the genome of a helper phage to construct a light chain-expressing helper phage. E. coli infected with this helper phage is capable of expressing the antibody light chain variable region and the light chain constant region, or only the light chain constant region.

Specifically, the genome was extracted from a helper phage M13KO7TC constructed by the method described in WO2015/046554, and a light chain expression unit was introduced into the genome. A gene encoding a light chain variable region and a light chain constant region (VK1-39-k0MTdC; SEQ ID NO: 152), or a gene encoding a light chain constant region (k0MTdC; SEQ ID NO: 153) was used as the light chain gene to be introduced. lac promoter-pelB signal sequence-light chain gene was inserted into M13KO7TC/SacI by the method described above and transfected into an E. coli strain ER2738 by the electroporation method.

The obtained E. coli was cultured, and 2.5 M NaCl/10% PEG was added to the culture supernatant to purify helper phages by the PEG precipitation method. The titers of the obtained helper phages M13KO7TC-Vk1-39-k0MTdC and M13KO7TC-k0MTdC were confirmed by the general plaque formation method.

9-2 Preparation of library containing a plurality of VHH-CH1 molecules

Alpacas were immunized by a method known to those skilled in the art using 4 types of immunogens: a human IL-6R extracellular domain, a human CD3εγ heterodimer, a monkey CD3εγ heterodimer and a cell domain of human PlexinA1. 4 weeks later, PBMCs were collected. The CD3εγ heterodimers were prepared with reference to Journal of Molecular Biology (2000) 302: 899-916. From the collected PBMCs, VHH gene was amplified with reference to a method described in J. Immunol. Methods (2007) 324, 13. The amplified VHH gene fragment was connected with CH1-gene 3 gene and inserted into phagemid vectors to prepare a library containing a plurality of VHH-CH1 molecules containing VHH linked to CH1.

9-3 Method for Preparing Phage Population Presenting VHH-CH1/Full-Length Light Chain or VHH-CH1/Light Chain Constant Region A phagemid vector having an insert of a gene encoding VHH-CH1 is transfected into *E. coli* by the electroporation method. The obtained *E. coli* can be cultured and infected by the helper phage M13KO7TC-Vk1-39-k0MTdC prepared in Example 9-1 so that VHH-CH1 expressed from the phagemid vector and the full-length light chain expressed from the helper phage form an Fab structure to prepare a phage population presenting VHH-CH1/full-length light chain (VHH-CH1/Vk1-39-k0MTdC) on the surface of phagemids containing the gene encoding VHH-CH1. Also, the *E. coli* harboring the phagemid vector having an insert of a gene encoding VHH-CH1 can be cultured and infected by the helper phage M13KO7TC-k0MTdC prepared in Example 9-1 so that VHH-CH1 expressed from the phagemid vector and the light chain constant region expressed from the helper phage form a structure of VHH-CH1 associated with CL to prepare a phage population presenting VHH-CH1/light chain constant region (VHH-CH1/k0MTdC). 2.5 M NaCl/ 10% PEG can be added to the culture supernatant to purify phages by the PEG precipitation method. The titers of the obtained phages can be confirmed by the general plaque formation method.

9-4 Obtainment of VHH-CH1 containing Plexin A1 VHH whose antigen binding is inhibited by association with light chain variable region and that exhibits antigen-binding ability in absence of light chain variable region, from VHH-CH1 phage library VHH-CH1 containing VHH whose antigen binding is inhibited by association with a light chain variable region and that exhibited antigen-binding ability in absence of the light chain variable region was obtained by panning from the VHH-CH1 library prepared in Example 9-2.

The antigen used was biotin-labeled human Plexin A1 prepared in Reference Example.

The panning method was performed according to the following steps:

(1) A phage population presenting VHH-CH1/light chain constant region (VHH-CH1/k0MTdC) is produced by the method of Example 9-3 from the VHH-CH1 phage library prepared in Example 9-2, and phages bound with antigen-immobilized magnetic beads are recovered from the population.

(2) A phage population presenting VHH-CH1/full-length light chain (VHH-CH/Vk1-39-k0MTdC) is produced by the method of Example 9-3 from the recovered phages, and phages unbound with the antigen-immobilized magnetic beads are recovered from the population.

(3) The recovered phages are repetitively subjected to the steps (1) and (2) to recover the desired phage.

As a result of the panning, a plurality of VHH-CH1 molecules were able to be selected whose Plexin A1 binding was inhibited by association with the light chain Vk1-39-k0MTdC and that exhibited binding ability against Plexin A1 in the absence of the light chain variable region.

Another panning method was performed according to the following steps:

(1) A phage population presenting VHH-CH1/light chain constant region (VHH-CH1/k0MTdC) is produced by the method of Example 9-3 from the VHH-CH1 phage library prepared in Example 9-2, and phages bound with antigen-immobilized magnetic beads are recovered from the population.

(2) A phage population presenting VHH-CH1/full-length light chain (VHH-CH1/Vk1-39-k0MTdC) is produced by the method of Example 9-3 from the recovered phages, and phages unbound with the antigen-immobilized magnetic beads are recovered from the population. Phages binding to anti-light chain antibody (EY Laboratories, Inc., Cat. BAT-2107-2)-immobilized magnetic beads are further recovered from the recovered phages.

(3) The recovered phages are repetitively subjected to the steps (1) and (2) to recover the desired phage.

As a result of the panning, a plurality of VHH-CH1 molecules were able to be selected whose Plexin A1 binding was inhibited by association with the light chain Vk1-39-k0MTdC and that exhibited binding ability against Plexin A1 in the absence of the light chain variable region.

The VHH in the VHH-CH1 thus selected by panning can be used in the preparation of IgG antibody-like molecules.

9-5 Preparation of Protease-Activated IgG Antibody-Like Molecules with Incorporated VHH Binding to Plexin A1

A nucleotide sequence encoding the VHH contained in each VHH-CH1 molecule selected in Example 9-4 was connected to a nucleotide sequence encoding a protease cleavage site and a heavy chain constant region by the method described in Example 3. The resultant was used as the heavy chain of an IgG antibody-like molecule and combined with a full-length light chain VK1-39-k0MT (SEQ ID NO: 3). IgG antibody-like molecules were expressed by transient expression using FreeStyle 293 cells (Invitrogen Corp.) by a method known to those skilled in the art, and purified by a method known to those skilled in the art using protein A.

The prepared IgG antibody-like molecules are shown in Table 4.

TABLE 4

IgG Antibody-like Molecules Containing a VHH that Binds to Human Plexin A1

| IgG antibody-like molecule | Heavy chain Name | Heavy chain SEQ ID NO | Light chain Name | Light chain SEQ ID NO |
|---|---|---|---|---|
| PX02-R2_001-G1mISHI01/VK1-39-k0MT | PX02-R2_001-G1mISHI01 | 154 | VK1-39-k0MT | 3 |
| PX02-R4_004-G1mISHI01/VK1-39-k0MT | PX02-R4_004-G1mISHI01 | 155 | | |
| PX02-R4_017-G1mISHI01/VK1-39-k0MT | PX02-R4_017-G1mISHI01 | 156 | | |
| PX03-R2_006-G1mISHI01/VK1-39-k0MT | PX03-R2_006-G1mISHI01 | 157 | | |
| PX03-R4_009-G1mISHI01/VK1-39-k0MT | PX03-R4_009-G1mISHI01 | 158 | | |

9-6 Activation of Protease-Activated IgG Antibody-Like Molecule by Protease Cleavage The IgG antibody-like molecules prepared in Example 9-4 were cleaved by protease in the same way as in Example 3, and the degree of the cleavage was evaluated by reducing SDS-PAGE. The results are shown in FIG. 22. The protease concentration was set to 25 nM.

As a result, the prepared IgG antibody-like molecules were each confirmed to undergo protease cleavage at the protease cleavage sequence.

Next, the human Plexin A1 binding evaluation of VHH released by protease treatment was conducted in the same way as in Example 3. Octet sensorgrams are shown in FIG. 23.

As a result, each of the prepared IgG antibody-like molecules did not exhibit antigen binding before the protease treatment, whereas the antigen binding of the released VHH was confirmed after the protease treatment.

Example 10 Polypeptides Containing Bispecific VHH-VHH 10-1 Bispecific VHH-VHH Binding to Cancer Antigen and CD3, and Preparation of Polypeptide Containing the Bispecific VHH-VHH As shown in FIG. 8, a protease-activated antigen-binding domain may form a bispecific antigen-binding molecule with a second antigen-binding domain.

VHH HN3 (SEQ ID NO: 159) recognizing human glypican 3 and VHH G03 (SEQ ID NO: 160) recognizing CD3 were connected via a linker constituted by glycine and serine to prepare bispecific VHH-VHH HN3G03. An antibody heavy chain constant region shown in SEQ ID NO: 161 was further connected thereto via a protease cleavage sequence, and the resulting heavy chain HN3G03-cF760mnHIF (SEQ ID NO: 162) containing the bispecific VHH-VHH was inserted into a vector for expression in animals.

VHH HerF07 (SEQ ID NO: 163) recognizing Her2 and VHH G03 (SEQ ID NO: 160) recognizing CD3 were connected via a linker constituted by glycine and serine to prepare bispecific VHH-VHH HerF07G03. An antibody heavy chain constant region shown in SEQ ID NO: 161 was further connected thereto via a protease cleavage sequence, and the resulting heavy chain HerF07G03-cF760mnHIF (SEQ ID NO: 164) containing the bispecific VHH-VHH was inserted into a vector for expression in animals.

Expi293 cells (Life Technologies Corp.) were cotransfected with each heavy chain containing the bispecific VHH-VHH and vectors for expression in animals respectively having inserts of a light chain VK1.39-k0MT (SEQ ID NO: 3) and a human constant region sequence VHn-Kn010dGK (SEQ ID NO: 166) from the hinge region to the C terminus, to express a polypeptide containing the bispecific VHH-VHH. Then, the polypeptide containing the bispecific VHH-VHH was purified by a method known to those skilled in the art using a MonoSpin ProA 96-well plate type (GL Sciences Inc., Cat No.: 7510-11312). The polypeptide containing the bispecific VHH-VHH HN3G03 is HN3G03-cF760mnHIF/VHn-Kn010dGK/VK1.39-k0MT, and the polypeptide containing the bispecific VHH-VHH HerF07G03 is HerF07G03-cF760mnHIF/VHn-Kn010dGK/VK1.39-k0MT.

Figure 24:
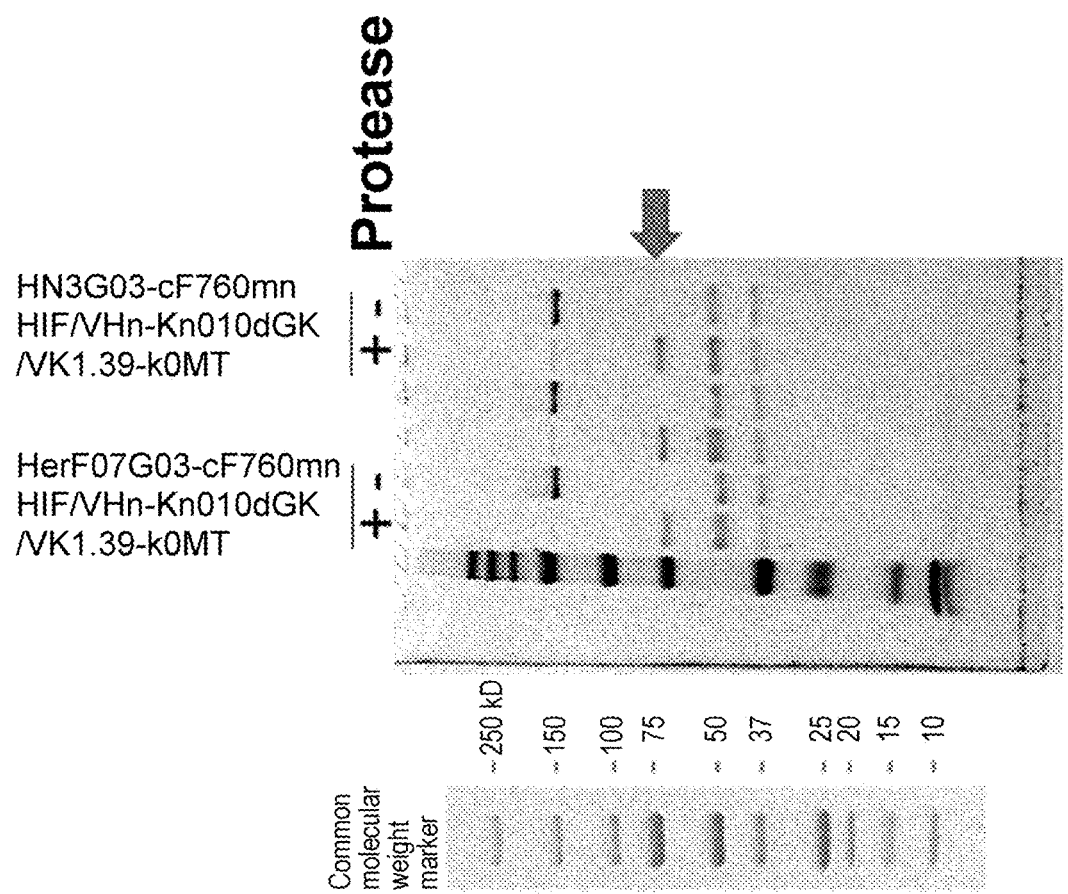
FIG. 24 is a diagram showing SDS-PAGE results of evaluating the protease cleavage of polypeptides containing bispecific VHH-VHH.

For protease treatment, uPA (Recombinant Human u-Plasminogen Activator, R&D Systems, Inc.) (final concentration: 25 nM) was added to 40 µg of each purified polypeptide containing the bispecific VHH-VHH and incubated at 37° C. for 20 hours or longer. Protease-untreated samples were incubated after addition of PBS instead of protease in the same amount as in the protease. Whether the protease-cleaved polypeptide containing the bispecific VHH-VHH underwent the cleavage as intended was confirmed by reducing SDS-PAGE. The results are shown in FIG. 24. As shown in FIG. 24, it was suggested that the bispecific VHH-VHH was separated from the whole molecule by the protease cleavage.

Figure 25:
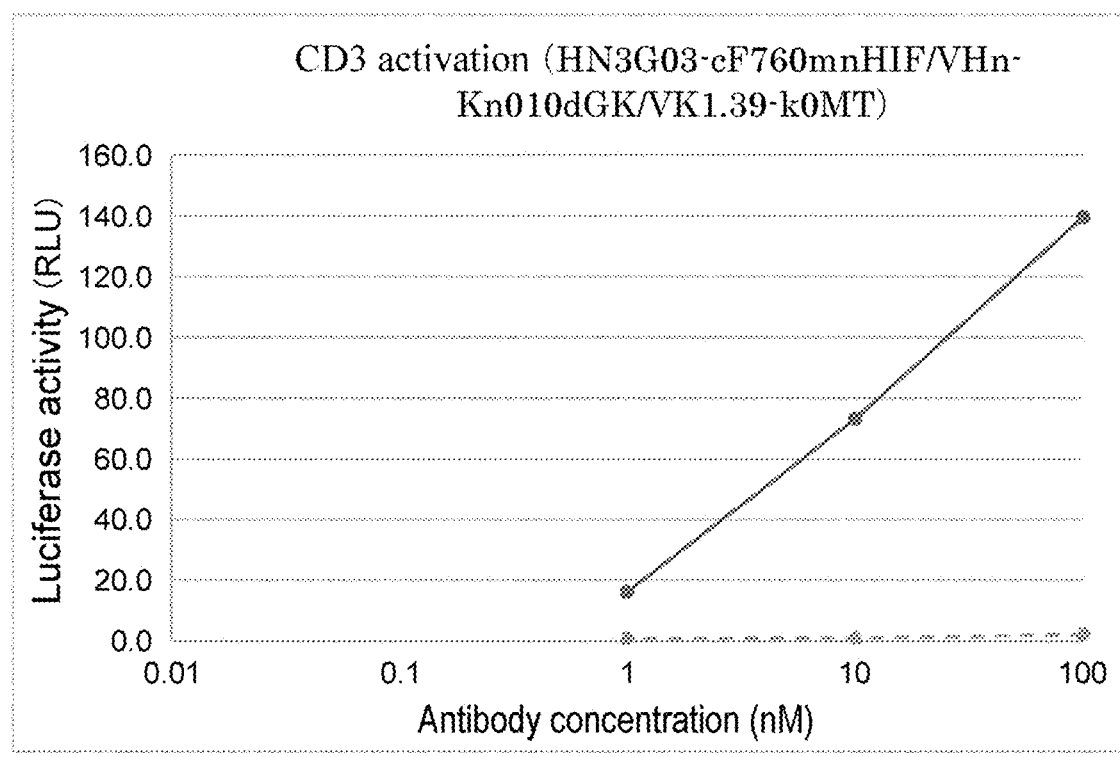
FIG. 25 is a diagram showing luciferase activity before and after protease cleavage. The broken line depicts samples without protease treatment, and the solid line depicts samples with protease treatment.

10-2 CD3 Activation Evaluation of Polypeptide Containing Bispecific VHH-VHH Against GPC3 and CD3 by Protease Cleavage Agonist activity against CD3 was evaluated using Jurkat-NFAT reporter cells (NFAT luc2_jurkat cell). The Jurkat-NFAT reporter cells are a cell line of CD3-expressing human acute T-cell leukemia-derived cells fused with an NFAT response element and luciferase (luc2P) and express luciferase by the activation of a signal downstream of CD3. The target cells used for antibodies based on GPC3 were a SK-pca60 cell line established by forcing a human liver cancer-derived cell line SK-HEP-1 to express human GPC3. The target cells and the effector cells were added at 1.25E+04 cells/well and 7.50E+04 cells/well, respectively, to each well of White-bottomed, 96-well assay plate (Costar, 3917). HN3G03-cF760mnHIF/VHn-Kn010dGK/VK1.39-k0MT with or without protease treatment was added at a final concentration of 1 nM, 10 nM, or 100 nM to the wells. After 24-hour incubation at 37° C. in the presence of 5% CO2, the luciferase enzyme activity was measured as luminescence intensity using Bio-Glo luciferase assay system (Promega Corp., G7940) according to the attached protocol. 2104 EnVision was used in detection. The results are shown in FIG. 25. No elevation in luciferase activity was seen in the sample without protease treatment, whereas elevation in luciferase activity was shown in HN3G03-cF760mnHIF/VHn-Kn010dGK/VK1.39-k0MT treated with protease. Specifically, HN3G03-cF760mnHIF/VHn-Kn010dGK/VK1.39-k0MT treated with protease was able to be confirmed to have agonist activity against CD3, while the bispecific VHH-VHH against GPC3 and CD3 was released from HN3G03-cF760mnHIF/VHn-Kn010dGK/VK1.39-k0MT by the protease cleavage and exerted the CD3 binding activity inhibited without cleavage.

Figure 26:
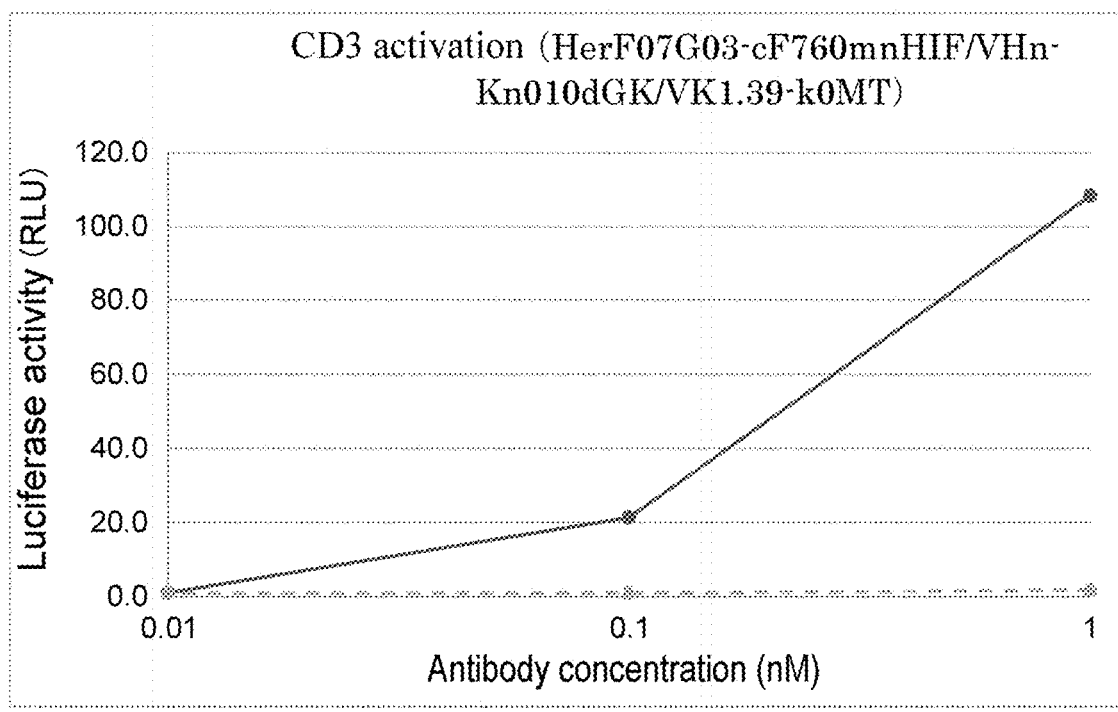
FIG. 26 is a diagram showing luciferase activity before and after protease cleavage. The broken line depicts samples without protease treatment, and the solid line depicts samples with protease treatment.

10-3 CD3 Activation Evaluation of Polypeptide Containing Bispecific VHH-VHH Against Her2 and CD3 by Protease Cleavage Agonist activity against CD3 was evaluated using Jurkat-NFAT reporter cells (NFAT luc2_jurkat cell). The Jurkat-NFAT reporter cells (effector cells) are a cell line of CD3-expressing human acute T-cell leukemia-derived cells fused with an NFAT response element and luciferase (luc2P) and express luciferase by the activation of a signal downstream of CD3. The target cells used were a LS1034 cell line. The target cells and the effector cells were added at 2.50E+04 cells/well and 7.50E+04 cells/well, respectively, to each well of White-bottomed, 96-well assay plate (Costar, 3917). HerF07G03-cF760mnHIF/VHn-Kn010dGK/VK1.39-k0MT with or without protease treatment was added at a final concentration of 0.01 nM, 0.1 nM, and 1 nM to the wells. After 24-hour incubation at 37° C. in the presence of 5% CO2, the luciferase enzyme activity was measured as luminescence intensity using Bio-Glo luciferase assay system (Promega Corp., G7940) according to the attached protocol. 2104 EnVision was used in detection. The results are shown in FIG. 26. No elevation in luciferase activity was seen in the sample without protease treatment, whereas elevation in luciferase activity was shown in HerF07G03-cF760mnHIF/VHn-Kn010dGK/VK1.39-k0MT treated with protease. Specifically, HerF07G03-cF760mnHIF/VHn-Kn010dGK/VK1.39-k0MT treated with protease was able to be confirmed to have agonist activity against CD3, while the bispecific VHH-VHH against Her2 and CD3 was released from HerF07G03-cF760mnHIF/VHn-Kn010dGK/VK1.39-k0MT by the protease cleavage and exerted the CD3-binding activity inhibited without cleavage.

Example 11 Introduction of Various Protease Cleavage Sites to Polypeptide with Incorporated VHH 11-1 Introduction of Various Protease Cleavage Sequences to Polypeptide with Incorporated VHH Binding to IL-6R An expression vector encoding IL6R90-G1T4 (SEQ ID NO: 167) containing IL6R90 (SEQ ID NO: 1), VHH having binding and neutralizing activities against human IL-6R as described in WO2010/115998, fused with a human IgG1 constant region (CH1-hinge-CH2-CH3) was prepared by a method known to those skilled in the art. An IgG antibody-like molecule IL6R90-G1T4/VK1-39-k0MT (heavy chain: SEQ ID NO: 167, light chain: SEQ ID NO: 3) was expressed by transient expression using FreeStyle 293 cells (Invitrogen Corp.) or Expi293 cells (Life Technologies Corp.) by a method known to those skilled in the art, and purified by a method known to those skilled in the art using protein A.

Various protease cleavage sequences were inserted near the boundary between VHH and CH1 in the heavy chain of IL6R90-G1T4/VK1-39-k0MT. Expression vectors in which a protease cleavage sequence shown in Table 5 was inserted near the boundary between VHH and CH1 were prepared by methods known to those skilled in the art. Sequences of VHH-containing heavy chains harboring protease cleavage sequence are shown in Table 6.

These heavy chains were combined with a light chain. IgG1 antibody-like molecules shown in Table 7 harboring protease cleavage sequence near the boundary between VHH and CH1 were transiently expressed using FreeStyle 293 cells (Invitrogen Corp.) or Expi293 cells (Life Technologies Corp.) according to a method known to those skilled in the art, and purified according to a method known to those skilled in the art using protein A.

TABLE 5

Protease Cleavage Sequences

| SEQ ID NO | Cleavage sequence |
|---|---|
| 168 | TSGSGRSANARG |
| 169 | TSQSGRSANQRG |
| 170 | TSPSGRSAYPRG |
| 171 | TSGSGRSATPRG |
| 172 | TSQSGRSATPRG |
| 173 | TSASGRSATPRG |
| 174 | TSYSGRSAVPRG |
| 175 | TSYSGRSANFRG |
| 176 | TSSSGRSATPRG |
| 177 | TSTTGRSASPRG |
| 178 | TSTSGRSANPRG |

TABLE 6

VHH-containing Heavy Chains Harboring a Protease Cleavage Sequence

| SEQ ID NO | Name of VHH-containing heavy chain |
|---|---|
| 179 | IL6R90. 12aa0004-G1T4 |
| 180 | IL6R90. 12aa0010-G1T4 |
| 181 | IL6R90. 12aa0016-G1T4 |
| 182 | IL6R90. 12aa0054-G1T4 |

TABLE 6-continued

VHH-containing Heavy Chains Harboring a Protease Cleavage Sequence

| SEQ ID NO | Name of VHH-containing heavy chain |
|---|---|
| 183 | IL6R90. 12aa0063-G1T4 |
| 184 | IL6R90. 12aa0081-G1T4 |
| 185 | IL6R90. 12aa0089-G1T4 |
| 186 | IL6R90. 12aa0095-G1T4 |
| 187 | IL6R90. 12aa0103-G1T4 |
| 188 | IL6R90. 12aa0126-G1T4 |
| 189 | IL6R90. 12aa-G1T4 |

TABLE 7

IgG Antibody-like Molecules

| Name of IgG antibody-like molecule | SEQ ID NO of heavy chain | SEQ ID NO of light chain |
|---|---|---|
| IL6R90. 12aa0004 | 179 | 3 |
| IL6R90. 12aa0010 | 180 | 3 |
| IL6R90. 12aa0016 | 181 | 3 |
| IL6R90. 12aa0054 | 182 | 3 |
| IL6R90. 12aa0063 | 183 | 3 |
| IL6R90. 12aa0081 | 184 | 3 |
| IL6R90. 12aa0089 | 185 | 3 |
| IL6R90. 12aa0095 | 186 | 3 |
| IL6R90. 12aa0103 | 187 | 3 |
| IL6R90. 12aa0126 | 188 | 3 |
| IL6R90. 12aa | 189 | 3 |

Figure 27:
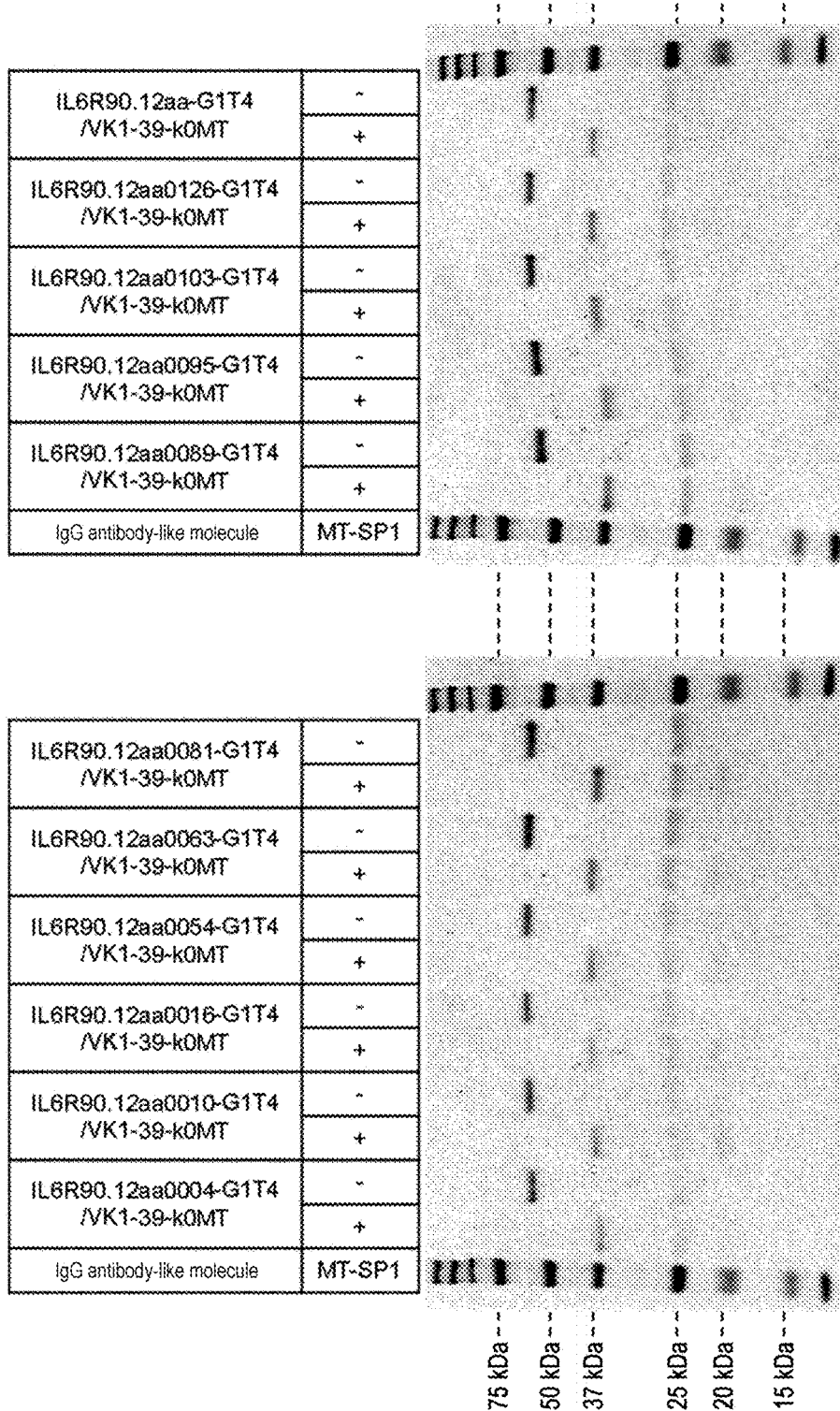
FIG. 27 is a diagram showing the SDS-PAGE evaluation of the protease cleavage of an IgG antibody-like molecule containing anti-human IL-6R VHH.

11-2 Protease Cleavage Evaluation of a Plurality of IgG Antibody-Like Molecules Containing Anti-Human IL-6R VHH Harboring a Protease Cleavage Sequence in the Heavy Chain Region Whether the IgG antibody-like molecules prepared in Example 11-1 would be cleaved by protease was verified. Recombinant Human Matriptase/ST14 Catalytic Domain (MT-SP1) (R&D Systems, Inc., 3946-SE-010) was used as the protease. 10 nM protease and 50 µg/mL antibody were reacted in PBS under a condition of 37° C. for 20 hours. Then, cleavage by the protease was evaluated by reducing SDS-PAGE. The results are shown in FIG. 27. As a result, protease treatment of IgG antibody-like molecules harboring any of the protease cleavage sequences generated a new band around 37 kDa. Thus, the IgG antibody-like molecules were confirmed to undergo protease cleavage at the protease cleavage sequences shown in Table 5 inserted near the boundary between VHH and CH1. Also, using similar method, the protease cleavage sequences shown in Table 5 were also confirmed to be cleaved by human uPA and mouse uPA when they are incorporated into an IgG antibody.

Example 12 Evaluation of Degree of Activation by Protease Cleavage of IgG Antibody-Like Molecule Harboring Protease Cleavage Sequence in its Light Chain An expression vector encoding IL6R75-G1m (SEQ ID NO: 191) containing IL6R75 (SEQ ID NO: 190), VHH having binding and neutralizing activities against human IL-6R as described in WO2010/115998, fused with a human IgG1 constant region (CH1-hinge-CH2-CH3) was prepared by a method known to those skilled in the art. IL6R75hu-G1m (SEQ ID NO: 192) was prepared by introducing amino acid alterations to the interface site between VHH and VL in the same way as in Example 4-2. IgG antibody-like molecules IL6R90-G1m/VK1-39P+4-Pk0MT (heavy chain: SEQ ID NO: 2, light chain: SEQ ID NO: 72), 20A11hu-G1m/VK1-39P+4-Pk0MT (heavy chain: SEQ ID NO: 39, light chain: SEQ ID NO: 72), and IL6R75hu-G1m/VK1-39P+4-Pk0MT (heavy chain: SEQ ID NO: 192, light chain: SEQ ID NO: 72) were expressed and purified in the same way as in Example 3 using the protease cleavage sequence-incorporated light chain VK1-39P+4-Pk0MT (SEQ ID NO: 72) and IL6R90-G1m (SEQ ID NO: 2), 20A11hu-G1m (SEQ ID NO: 39), and IL6R75hu-G1m (SEQ ID NO: 192) as heavy chains.

Figure 28:
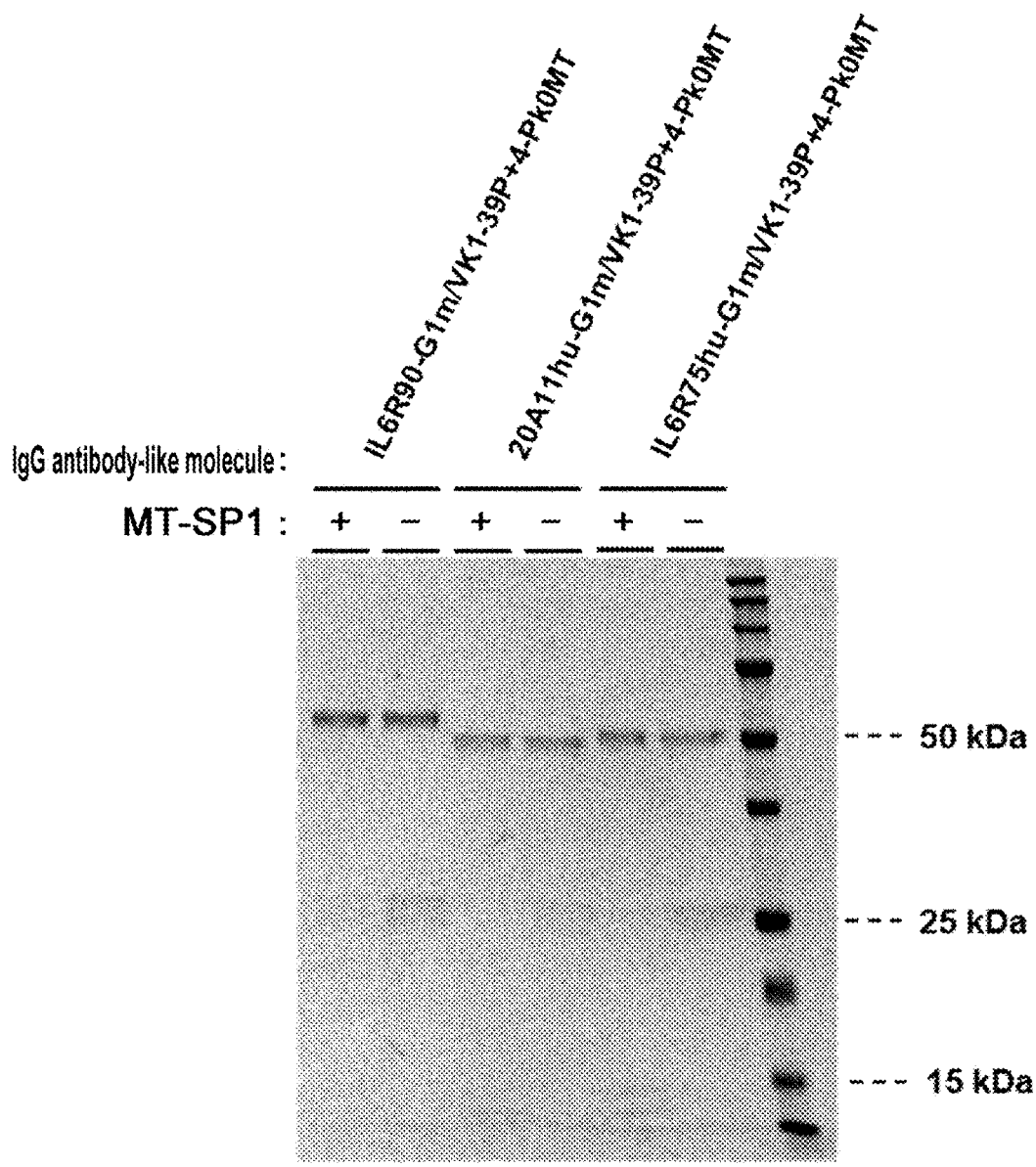
FIG. 28 is a diagram showing the evaluation of the protease cleavage of IgG antibody-like molecules harboring a protease cleavage sequence in their light chains.

IL6R90-G1m/VK1-39P+4-Pk0MT, 20A11hu-G1m/VK1-39P+4-Pk0MT, and IL6R75hu-G1m/VK1-39P+4-Pk0MT were cleaved by protease in the same way as in Example 3, and the degree of the cleavage was evaluated. The results are shown in FIG. 28. Specifically, recombinant Human Matriptase/ST14 Catalytic Domain (R&D Systems, Inc., 3946-SE-010) was used as the protease. 50 nM protease and 50 µg/mL of each IgG antibody-like molecule were reacted in PBS under a condition of 37° C. for 20 hours. Then, cleavage by the protease was evaluated by reducing SDS-PAGE. As a result, IL6R90-G1m/VK1-39P+4-Pk0MT, 20A11 hu-G1m/VK1-39P+4-Pk0MT, and IL6R75hu-G1m/VK1-39P+4-Pk0MT were confirmed to undergo protease cleavage near the boundary between VL and CL.

Figure 29:
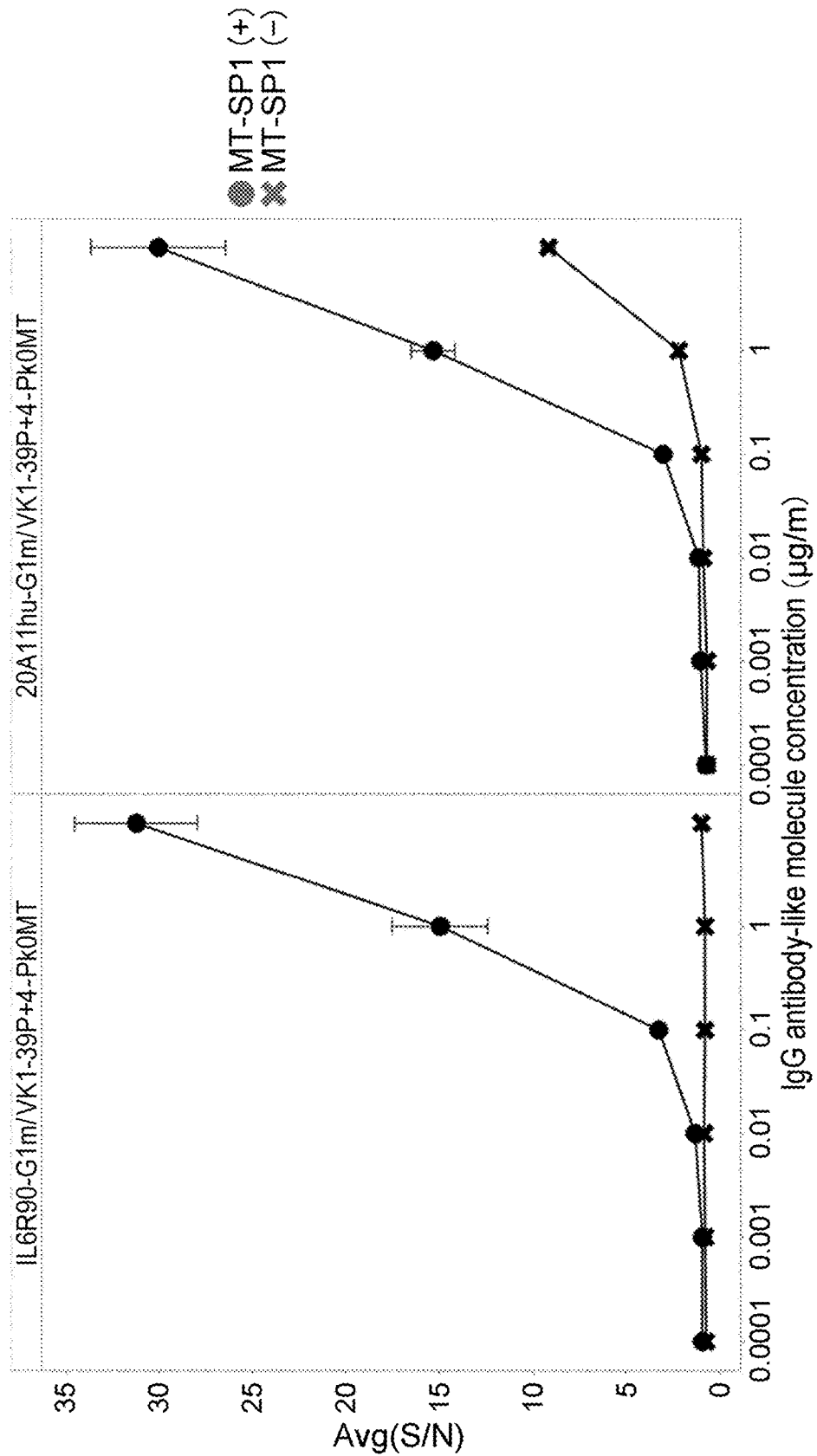
FIG. 29 is a diagram showing the evaluation of the degree of activation based on the presence or absence of the protease treatment of IgG-like antibody molecules harboring a protease cleavage sequence in their light chains.

Next, the IL6R binding of VHH exposed by protease treatment was evaluated by ELISA. Specifically, the hsIL-6R-BAP1 used in Example 3 was immobilized onto a streptavidin-coated 384-well plate (Greiner Bio-One GmbH, 781990), and each cleaved IgG antibody-like molecule was allowed to bind thereto at room temperature. After reaction for 30 minutes, a HRP-labeled anti-human IgG antibody (Sigma-Aldrich Co. LLC, SAB3701362-2MG) was allowed to act thereon at room temperature for 10 minutes, and TMB Chromogen Solution (Life Technologies Corp., 002023) was reacted therewith. After reaction at room temperature for 30 minutes, the reaction was terminated with sulfuric acid, followed by the measurement of absorbance at 450 nm using Synergy HTX multi-mode reader (BioTek Instruments, Inc.). The absorbance ratio of the antigen-immobilized wells to unimmobilized wells was calculated and used as a S/N ratio. The S/N ratio (mean) of ELISA was plotted on the ordinate against the concentration of each IgG antibody-like molecule on the abscissa. The results are shown in FIG. 29. These results showed that the protease-treated IgG antibody-like molecule 20A11hu-G1m/VK1-39P+4-Pk0MT harboring the cleavage sequence in its light chain had 10 or more times the IL-6R binding activity of the protease-untreated IgG antibody-like molecule, and the protease-treated IgG antibody-like molecule IL6R90-G1 m/VK1-39P+4-Pk0MT had 1000 or more times the IL-6R binding activity of the protease-untreated one.

Example 13 Preparation and Evaluation of IgG Antibody-Like Molecules Harboring Diverse Protease Cleavage Sequences

13-1 Preparation of Polypeptides Harboring Diverse Protease Cleavage Sequences IgG antibody-like molecules were prepared in the same way as in Example 3 using recognition sequences for proteases other than urokinase or matriptase. Various peptide sequences known to be cleaved by MMP-2, MMP-7, MMP-9, or MMP-13 were each inserted near the boundary between the variable and constant regions of IL6R90-G1m, and a peptide sequence containing a flexible linker consisting of a glycine-serine polymer was inserted into the vicinity of these cleavage sequences. The inserted sequences are shown in Table 8.

TABLE 8

Various Inserted Sequences

| Protease | Inserted sequence | SEQ ID NO |
|---|---|---|
| MMP-2 MMP-9 | PLGLAG | 25 |
| MMP-2 | GAGIPVSLRSGAG | 78 |
| MMP-2 | GPLGIAGQ | 79 |
| MMP-2 | GGPLGMLSQS | 80 |
| MMP-2 | PLGLWA | 81 |
| MMP-7 | VPLSLTMG | 26 |
| MMP-7 | GAGVPLSLTMGAG | 83 |
| MMP-9 | GAGVPLSLYSGAG | 84 |
| MMP-13 | GAGPQGLAGQRGIVAG | 91 |
| MMP-2 MMP-9 | GGGGSPLGLAGGGGGS | 193 |
| MMP-2 | GGGGSGPLGIAGQGGGGS | 194 |
| MMP-9 | GGGGSGAGVPLSLYSGAGGGGGS | 195 |

Various Inserted Sequences

Heavy chains were designed such that these sequences were inserted near the boundary between the variable and constant regions of IL6R90-G1m. Expression vectors encoding the heavy chain variants 6R90EIVHEMP2.1-6R90EICHEMP2.1G1m (SEQ ID NO: 165), 6R90EIVHEMP2.2-6R90EICHEMP2.2G1 m (SEQ ID NO: 202), 6R90EIVHEMP2.3-6R90EICHEMP2.3G1m (SEQ ID NO: 203), 6R90EIVHEMP2.4-6R90EICHEMP2.4G1m (SEQ ID NO: 204), 6R90EIVHEMP7.1-6R90EICHEMP7.1G1m (SEQ ID NO: 205), 6R90EIVHEMP7.2-6R90EICHEMP7.2G1m (SEQ ID NO: 206), 6R90EIVHEMP13-6R90EICHEMP13G1m (SEQ ID NO: 207), 6R90EIVHEG4SMP2MP9G4S-6R90EICHEG4SMP2MP9G4SG1m (SEQ ID NO: 196), 6R90EIVHEG4SMP2.2G4S-6R90EIVHEG4SMP2.2G4SG1m (SEQ ID NO: 197), and 6R90EIVHEG4SMP9G4S-6R90EIVHEG4SMP9G4SG1m (SEQ ID NO: 198) were prepared by a method known to those skilled in the art.

Table 9 shows the IgG antibody-like molecules combining these heavy chain variants with a light chain and harboring the protease cleavage sequence near the boundary between the variable and constant regions of the heavy chain. These IgG antibody-like molecules were expressed by transient expression using FreeStyle 293 cells (Invitrogen Corp.) or Expi293 cells (Life Technologies Corp.) by a method known to those skilled in the art, and purified by a method known to those skilled in the art using protein A.

TABLE 9

IgG Antibody-like Molecules

| Protease | IgG antibody-like molecule | SEQ ID NO of heavy chain | SEQ ID NO of light chain |
|---|---|---|---|
| MMP-2 | 6R90EIVHEMP2.1-6R90EICHEMP2.1G1m/VK1-39-k0MT | 165 | 3 |
| MMP-2 | 6R90EIVHEMP2.2-6R90EICHEMP2.2G1m/VK1-39-k0MT. | 202 | 3 |
| MMP-2 | 6R90EIVHEMP2.3-6R90EICHEMP2.3G1m/VK1-39-k0MT. | 203 | 3 |
| MMP-2 | 6R90EIVHEMP2.4-6R90EICHEMP2.4G1m/VK1-39-k0MT. | 204 | 3 |
| MMP-7 | 6R90EIVHEMP7.1-6R90EICHEMP7.1G1m/VK1-39-k0MT. | 205 | 3 |
| MMP-7 | 6R90EIVHEMP7.2-6R90EICHEMP7.2G1m/VK1-39-k0MT | 206 | 3 |
| MMP-13 | 6R90EIVHEMP13-6R90EICHEMP13G1m/VK1-39-k0MT | 207 | 3 |
| MMP-2 MMP-9 | 6R90EIVHEG4SMP2MP9G4S-6R90EICHEG4SMP2MP9G4SG1m/VK1-39-k0MT | 196 | 3 |
| MMP-2 | 6R90EIVHEG4SMP2.2G4S-6R90EICHEG4SMP2.2G4SG1m/VK1-39-k0MT | 197 | 3 |
| MMP-9 | 6R90EIVHEG4SMP9G4S-6R90EICHEG4SMP9G4SG1m/VK1-39-k0MT | 198 | 3 |

Figure 30A:
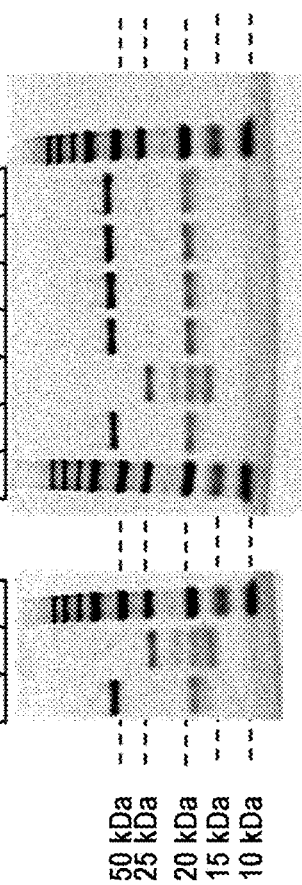
FIG. 30A is a diagram showing the evaluation of the protease cleavage of IgG antibody-like molecules harboring a protease cleavage sequence in their heavy chains.
Figure 30B:
FIG. 30B is a diagram showing the evaluation of the protease cleavage of IgG antibody-like molecules harboring a protease cleavage sequence in their heavy chains. The cleavage by protease was carried out using an assay buffer (MMP Activity Assay Kit (Fluorometric—Green) (ab112146), Component C: Assay Buffer).

13-2 Protease Cleavage Evaluation of IgG Antibody-Like Molecules Harboring Diverse Protease Cleavage Sequences Whether the IgG antibody-like molecules prepared in Example 13-1 would be cleaved by protease was verified. Recombinant human MMP-2 (R&D Systems, Inc., 902-MP-010), recombinant human MMP-7 (R&D Systems, Inc., 907-MP-010), recombinant human MMP-9 (R&D Systems, Inc., 911-MP-010), or recombinant human MMP-13 (R&D Systems, Inc., 511-MM-010) was used as the protease. MMP-2, MMP-7, MMP-9, and MMP-13 were used after being each mixed with 1 MMP-aminophenylmercuric acetate (APMA; Abcam PLC, ab112146) and activated at 37° C. for 1 hour or 24 hours. 50 nM, 100 nM, or 500 nM protease and 50 μg/mL or 100 μg/mL of each IgG-antibody like molecule were reacted in PBS or 20 mM Tris-HCl, 150 mM NaCl, and 5 mM CaCl₂ (pH 7.2) (hereinafter, referred to as Tris) under a condition of 37° C. for 20 hours. Then, cleavage by the protease was evaluated by reducing SDS-PAGE. The results are shown in FIGS. 30A and 30B. In FIG. 30B, the protease cleavage was carried out using an assay buffer (MMP Activity Assay Kit (Fluorometric—Green) (ab112146), Component C: Assay Buffer).

As a result, 6R90EIVHEMP2.1-6R90EICHEMP2.1G1m/VK1-39-k0MT, 6R90EIVHEMP2.2-6R90EICHEMP2.2G1m/VK1-39-k0MT, 6R90EIVHEMP2.3-6R90EICHEMP2.3G1m/VK1-39-k0MT, 6R90EIVHEMP2.4-6R90EICHEMP2.4G1m/VK1-39-k0MT, 6R90EIVHEG4SMP2MP9G4S-6R90EICHEG4SMP2MP9G4SG1m/VK1-39-k0MT, and 6R90EIVHEG4SMP2.2G4S-6R90EICHEG4SMP2.2G4SG1m/VK1-39-k0MT were confirmed to be cleaved by MMP-2. 6R90EIVHEMP7.1-6R90EICHEMP7.1G1m/VK1-39-k0MT and 6R90EIVHEMP7.2-6R90EICHEMP7.2G1m/VK1-39-k0MT were confirmed to be cleaved by MMP-7. 6R90EIVHEG4SMP2MP9G4S-6R90EICHEG4SMP2MP9G4SG1m/VK1-39-k0MT and 6R90EIVHEG4SMP9G4S-6R90EICHEG4SMP9G4SG1m/VK1-39-k0MT were confirmed to be cleaved by MMP-9. 6R90EIVHEMP13-6R90EICHEMP13G1m/VK1-39-k0MT was confirmed to be cleaved by MMP-13.

Example 14 Evaluation of Various Protease Cleavage Sequences 14-1 Preparation of Antibody Variants Harboring Various Protease Cleavage Sequences The protease cleavage sequences shown in Table 10 were inserted near the boundary between the light chain variable region and constant region of antibodies having the heavy chain of SEQ ID NO: 831 and the light chain of SEQ ID NO: 832 to prepare light chain variants harboring different protease cleavage sequences (Table 11).

The light chain variants harboring the protease cleavage sequence prepared as described above were combined with the heavy chain of SEQ ID NO: 831, and the antibody variants shown in Table 12 were transiently expressed using Expi293 cells (Life Technologies) according to a method known to those skilled in the art, and purified according to a method known to those skilled in the art using protein A.

TABLE 10

Protease Cleavage Sequences

| SEQ ID NO | Cleavage sequence |
|---|---|
| 178 | TSTSGRSANPRG |
| 488 | TSYTGRSAVPRG |
| 489 | TSYSGRSAVYRG |
| 490 | TSYSGRSAVVRG |
| 491 | TSYSGRSAVHRG |
| 492 | TSYTGRSAVYRG |
| 493 | TSYTGRSAVVRG |

TABLE 10-continued

Protease Cleavage Sequences

| SEQ ID NO | Cleavage sequence |
|---|---|
| 494 | TSYTGRSAVHRG |
| 500 | TSYTGRSAVPGG |
| 501 | TSYSGRSAVYGG |
| 502 | TSYSGRSAVVGG |
| 503 | TSYSGRSAVHGG |
| 504 | TSYTGRSAVYGG |
| 505 | TSYTGRSAVVGG |
| 506 | TSYTGRSAVHGG |

TABLE 11

Light Chain Variants

| SEQ ID NO | Name of light chain variant |
|---|---|
| 816 | G7L.106a.12aa-LT0 |
| 817 | G7L.12aa0089.001-LT0 |
| 818 | G7L.12aa0089.002-LT0 |
| 819 | G7L.12aa0089.003-LT0 |
| 820 | G7L.12aa0089.004-LT0 |
| 821 | G7L.12aa0089.005-LT0 |
| 822 | G7L.12aa0089.006-LT0 |
| 823 | G7L.12aa0089.007-LT0 |
| 824 | G7L.12aa0089.001.R11G-LT0 |
| 825 | G7L.12aa0089.002.R11G-LT0 |
| 826 | G7L.12aa0089.003.R11G-LT0 |
| 827 | G7L.12aa0089.004.R11G-LT0 |
| 828 | G7L.12aa0089.005.R11G-LT0 |
| 829 | G7L.12aa0089.006.R11G-LT0 |
| 830 | G7L.12aa0089.007.R11G-LT0 |

TABLE 12

Antibody Variants

| Name of antibody variant | SEQ ID NO of heavy chain | SEQ ID NO of light chain |
|---|---|---|
| G7L.106a.12aa | 831 | 816 |
| G7L.12aa0089.001 | 831 | 817 |
| G7L.12aa0089.002 | 831 | 818 |
| G7L.12aa0089.003 | 831 | 819 |
| G7L.12aa0089.004 | 831 | 820 |
| G7L.12aa0089.005 | 831 | 821 |
| G7L.12aa0089.006 | 831 | 822 |
| G7L.12aa0089.007 | 831 | 823 |
| G7L.12aa0089.001.R11G | 831 | 824 |
| G7L.12aa0089.002.R11G | 831 | 825 |
| G7L.12aa0089.003.R11G | 831 | 826 |
| G7L.12aa0089.004.R11G | 831 | 827 |
| G7L.12aa0089.005.R11G | 831 | 828 |
| G7L.12aa0089.006.R11G | 831 | 829 |
| G7L.12aa0089.007.R11G | 831 | 830 |

14-2 Evaluation of Protease Cleavage of Antibody Variants Harboring a Protease Cleavage Sequence The antibody variants prepared in 14-1 were tested to see whether they would be cleaved by protease treatment. The protease used was recombinant human u-Plasminogen Activator/Urokinase (human uPA, huPA) (R&D Systems; 1310-SE-010). The antibodies were allowed to react for one hour under the conditions of 40 nM protease, 100 μg/mL antibody variant, PBS, and 37° C., and then subjected to reducing SDS-PAGE. The results confirmed that all the antibody variants harboring protease cleavage sequence were cleaved by protease treatment. In other words, it was shown that the protease cleavage sequences in Table 10 can be cleaved by protease. In addition, the antibody variants other than G7L.106a.12aa were all cleaved more efficiently than G7L.106a.12aa.

Example 15 Evaluation of Various Protease Cleavage Sequences 15-1 Preparation of Antibody Variants Harboring Protease Cleavage Sequences In addition to the protease cleavage sequences discovered in Example 14, exploration of protease cleavage sequences was further carried out for improved cleavage efficiency and protease selectivity. The protease cleavage sequences shown in Table 13 were inserted near the boundary between the light chain variable region and constant region of antibodies having the heavy chain of SEQ ID NO: 831 and the light chain of SEQ ID NO: 832 to prepare light chain variants harboring different protease cleavage sequences (Tables 14 and 15).

TABLE 13

| Protease Cleavage Sequences | |
|---|---|
| SEQ ID NO | Cleavage Sequences |
| 853 | TSTSGRSANPRG |
| 854 | TSTSGRSANPAG |
| 855 | TSTSGRSANPHG |
| 856 | TSTSGRSANPIG |
| 857 | TSTSGRSANPLG |
| 858 | TSTSGRSANPSG |
| 859 | ISTSGRSANPIG |
| 860 | YSTSGRSANPIG |
| 861 | TSYSGRSAVPAG |
| 862 | TSPSGRSANIAG |
| 863 | TSPSQRSANFAG |
| 864 | TSPTGRSANPAG |
| 865 | TSPSGRSAIPAG |
| 866 | TSYTGRSANPAG |
| 867 | TSYSGRSAIPAG |
| 868 | TSISGRSANYAG |
| 869 | TSPSGRSAGPAG |
| 870 | TSYTGRSAVPAG |
| 871 | TSYTGRSAVYAG |
| 872 | TSYTGRSAVVAG |

TABLE 13-continued

Protease Cleavage Sequences

| SEQ ID NO | Cleavage Sequences |
|---|---|
| 873 | TSYTGRSAVHAG |
| 874 | TSYSGRSAVPHG |
| 875 | TSPSGRSANIHG |
| 876 | TSPSGRSAHFHG |
| 877 | TSPTGRSANPHG |
| 878 | TSPSGRSAIPHG |
| 879 | TSYTGRSANPHG |
| 880 | TSYSGRSAIPHG |
| 881 | TSISGRSANYHG |
| 882 | TSPSGRSAGPHG |
| 883 | TSYTGRSAVPHG |
| 884 | TSYTGRSAVYHG |
| 885 | TSYTGRSAVVHG |
| 886 | TSYTGRSAVHHG |
| 887 | TSYSGRSAVPIG |
| 888 | TSPSGRSANIIG |
| 889 | TSPSGRSANFIG |
| 890 | TSPSGRSANPIG |
| 891 | TSPSGRSAIPIG |
| 892 | TSYTGRSANPIG |
| 935 | ISYTGRSAVPIG |
| 936 | ISYTGRSAVYIG |
| 937 | ISYTGRSAVVIG |
| 938 | ISYTGRSAVHIG |
| 939 | YSYSGRSAVPIG |
| 940 | YSYSGRSANIIG |
| 941 | YSYTGRSANFIG |
| 942 | YSYTGRSANPIG |
| 943 | YSPSGRSAIPIG |
| 944 | YSYTGRSANPIG |
| 945 | YSYSGRSAIPIG |
| 946 | YSISGRSANYIG |
| 947 | YSYSGRSAGPIG |
| 948 | YSYTGRSAVPIG |
| 949 | YSYTGRSAVYIG |
| 950 | YSYTGRSAVVIG |
| 951 | YSYTGRSAVHIG |

TABLE 14

Light Chain Variants

| SEQ ID NO | Name of light chain variant |
|---|---|
| 952 | G7L.106a.12aa-LT0 |
| 953 | G7L.12aa0177.LT0 |
| 954 | G7L.12aa.0180-LT0 |
| 955 | G7L.12aa.0181-LT0 |
| 956 | G7L.12aa.0182-LT0 |
| 957 | G7L.12aa.0185-LT0 |
| 958 | G7L.12aa.0163-LT0 |
| 959 | G7L.12aa.0168-LT0 |
| 960 | G7L.12aa.0089.0177-LT0 |
| 961 | G7L.12aa.0019.0177-LT0 |
| 962 | G7L.12aa.0020.0177-LT0 |
| 963 | G7L.12aa.0069.0177-LT0 |
| 964 | G7L.12aa.0071.0177-LT0 |
| 965 | G7L.12aa.0087.0177-LT0 |
| 966 | G7L.12aa.0090.0177-LT0 |
| 967 | G7L.12aa.0120.0177-LT0 |
| 968 | G7L.12aa.0157.0177-LT0 |
| 969 | G7L.12aa.0089.001.0177-LT0 |
| 970 | G7L.12aa.0089.005.0177-LT0 |
| 971 | G7L.12aa.0089.005.0177-LT0 |
| 972 | G7L.12aa.0089.007.0177-LT0 |
| 973 | G7L.12aa.0089.0180-LT0 |
| 974 | G7L.12aa.0019.0180-LT0 |
| 975 | G7L.12aa.0020.0180-LT0 |
| 976 | G7L.12aa.0069.0180-LT0 |
| 977 | G7L.12aa.0071.0180-LT0 |
| 978 | G7L.12aa.0087.0180-LT0 |
| 979 | G7L.12aa.0090.0180-LT0 |
| 980 | G7L.12aa.0120.0180-LT0 |
| 981 | G7L.12aa.0157.0180-LT0 |
| 982 | G7L.12aa.0089.001.0180-LT0 |
| 983 | G7L.12aa.0089.005.0180-LT0 |
| 984 | G7L.12aa.0089.006.0180-LT0 |
| 985 | G7L.12aa.0089.007.0180-LT0 |
| 986 | G7L.12aa.0089.0181-LT0 |
| 987 | G7L.12aa.0019.0181-LT0 |
| 988 | G7L.12aa.0020.0181-LT0 |
| 989 | G7L.12aa.0069.0181-LT0 |
| 990 | G7L.12aa.0071.0181-LT0 |
| 991 | G7L.12aa.0087.0181-LT0 |
| 992 | G7L.12aa0090.0181-LT0 |
| 993 | G7L.12aa0120.0181-LT0 |
| 994 | G7L.12aa0157.0181-LT0 |
| 995 | G7L.12aa0089.001.0181-LT0 |
| 996 | G7L.12aa0089.005.0181-LT0 |
| 997 | G7L.12aa0089.006.0181-LT0 |
| 998 | G7L.12aa0089.007.0181-LT0 |
| 999 | G7L.12aa.0089.0182-LT0 |
| 1000 | G7L.12aa0019.0182-LT0 |
| 1001 | G7L.12aa0020.0182-LT0 |
| 1002 | G7L.12aa0089.0182-LT0 |
| 1003 | G7L.12aa0071.0182-LT0 |
| 1004 | G7L.12aa0087.0182-LT0 |
| 1005 | G7L.12aa0090.0182-LT0 |
| 1006 | G7L.12aa0120.0182-LT0 |
| 1007 | G7L.12aa0157.0182-LT0 |
| 1008 | G7L.12aa0089.001.0182-LT0 |
| 1009 | G7L.12aa0089.005.0182-LT0 |

TABLE 14-continued

Light Chain Variants

| SEQ ID NO | Name of light chain variant |
|---|---|
| 1010 | G7L.12aa0089.006.0182-LT0 |
| 1011 | G7L.12aa0089.007.0182-LT0 |
| 1012 | G7L.12aa0089.0185-LT0 |
| 1013 | G7L.12aa0019.0185-LT0 |
| 1014 | G7L.12aa0020.0185-LT0 |
| 1015 | G7L.12aa0089.0185-LT0 |
| 1016 | G7L.12aa0071.0185-LT0 |
| 1017 | G7L.12aa0087.0185-LT0 |
| 1018 | G7L.12aa0090.0185-LT0 |
| 1019 | G7L.12aa0120.0185-LT0 |
| 1020 | G7L.12aa0157.0185-LT0 |
| 1021 | G7L.12aa0089.001.0185-LT0 |
| 1022 | G7L.12aa0089.005.0185-LT0 |
| 1023 | G7L.12aa0089.006.0185-LT0 |
| 1024 | G7L.12aa0089.007.0185-LT0 |
| 1025 | G7L.12aa0089.0200-LT0 |
| 1026 | G7L.12aa0019.0200-LT0 |
| 1027 | G7L.12aa0020.0200-LT0 |
| 1028 | G7L.12aa0069.0200-LT0 |
| 1029 | G7L.12aa0071.0200-LT0 |
| 1030 | G7L.12aa0087.0200-LT0 |
| 1031 | G7L.12aa0090.0200-LT0 |
| 1032 | G7L.12aa0120.0200-LT0 |
| 1033 | G7L.12aa0157.0200-LT0 |
| 1034 | G7L.12aa0089.001.0200-LT0 |
| 1035 | G7L.12aa0089.005.0200-LT0 |
| 1036 | G7L.12aa0089.006.0200-LT0 |
| 1037 | G7L.12aa0089.007.0200-LT0 |
| 1038 | G7L.12aa0089.0203-LT0 |
| 1039 | G7L.12aa0019.0203-LT0 |
| 1040 | G7L.12aa0020.0203-LT0 |
| 1041 | G7L.12aa0069.0203-LT0 |
| 1042 | G7L.12aa0071.0203-LT0 |
| 1043 | G7L.12aa0087.0203-LT0 |
| 1044 | G7L.12aa0090.0203-LT0 |
| 1045 | G7L.12aa0120.0203-LT0 |
| 1046 | G7L.12aa0157.0203-LT0 |
| 1047 | G7L.12aa0069.001.0203-LT0 |
| 1048 | G7L.12aa0089.005.0203-LT0 |
| 1049 | G7L.12aa0089.006.0203-LT0 |
| 1050 | G7L.12aa0089.007.0203-LT0 |

TABLE 15

Antibody Variants

| Name of antibody variant | SEQ ID NO: of heavy chain | SEQ ID NO: of light chain |
|---|---|---|
| G7L.106a.12aa | 831 | 952 |
| G7L.12aa.0177 | 831 | 953 |
| G7L.12aa.0180 | 831 | 954 |
| G7L.12aa.0181 | 831 | 955 |
| G7L.12aa.0182 | 831 | 956 |
| G7L.12aa.0185 | 831 | 957 |
| G7L.12aa.0163 | 831 | 958 |
| G7L.12aa.0166 | 831 | 959 |
| G7L.12aa.0089.0177 | 831 | 960 |
| G7L.12aa.0019.0177 | 831 | 961 |
| G7L.12aa.0020.0177 | 831 | 962 |
| G7L.12aa.0069.0177 | 831 | 963 |
| G7L.12aa.0071.0177 | 831 | 964 |
| G7L.12aa.0087.0177 | 831 | 965 |
| G7L.12aa.0090.0177 | 831 | 966 |
| G7L.12aa.0120.0177 | 831 | 967 |
| G7L.12aa.0157.0177 | 831 | 968 |
| G7L.12aa.0089.001.0177 | 831 | 969 |
| G7L.12aa.0089.005.0177 | 831 | 970 |
| G7L.12aa.0089.006.0177 | 831 | 971 |
| G7L.12aa.0089.007.0177 | 831 | 972 |
| G7L.12aa.0089.0180 | 831 | 973 |
| G7L.12aa.0019.0180 | 831 | 974 |
| G7L.12aa.0020.0180 | 831 | 975 |
| G7L.12aa.0069.0180 | 831 | 976 |
| G7L.12aa.0071.0180 | 831 | 977 |
| G7L.12aa.0087.0180 | 831 | 978 |
| G7L.12aa.0090.0180 | 831 | 979 |
| G7L.12aa.0120.0180 | 831 | 980 |
| G7L.12aa.0157.0180 | 831 | 981 |
| G7L.12aa.0089.001.0180 | 831 | 982 |
| G7L.12aa.0089.005.0180 | 831 | 983 |
| G7L.12aa.0089.006.0180 | 831 | 984 |
| G7L.12aa.0089.007.0180 | 831 | 985 |
| G7L.12aa.0089.0181 | 831 | 986 |
| G7L.12aa.0019.0181 | 831 | 987 |
| G7L.12aa.0020.0181 | 831 | 988 |
| G7L.12aa.0069.0181 | 831 | 989 |
| G7L.12aa.0071.0181 | 831 | 990 |
| G7L.12aa.0087.0181 | 831 | 991 |
| G7L.12aa.0090.0181 | 831 | 992 |
| G7L.12aa.0120.0181 | 831 | 993 |
| G7L.12aa.0157.0181 | 831 | 994 |
| G7L.12aa.0089.001.0181 | 831 | 995 |
| G7L.12aa.0089.005.0181 | 831 | 996 |
| G7L.12aa.0089.006.0181 | 831 | 997 |
| G7L.12aa.0089.007.0181 | 831 | 998 |
| G7L.12aa.0089.0182 | 831 | 999 |
| G7L.12aa.0019.0182 | 831 | 1000 |
| G7L.12aa.0020.0182 | 831 | 1001 |
| G7L.12aa.0069.0182 | 831 | 1002 |
| G7L.12aa.0071.0182 | 821 | 1003 |
| G7L.12aa.0087.0182 | 831 | 1004 |
| G7L.12aa.0090.0182 | 831 | 1005 |
| G7L.12aa.0120.0182 | 831 | 1006 |
| G7L.12aa.0157.0182 | 831 | 1007 |
| G7L.12aa.0089.001.0182 | 831 | 1008 |
| G7L.12aa.0089.005.0182 | 831 | 1009 |
| G7L.12aa.0089.006.0182 | 831 | 1010 |
| G7L.12aa.0089.007.0182 | 831 | 1011 |
| G7L.12aa.0089.0185 | 831 | 1012 |
| G7L.12aa.0019.0185 | 831 | 1013 |
| G7L.12aa.0020.0185 | 831 | 1014 |
| G7L.12aa.0069.0185 | 831 | 1015 |
| G7L.12aa.0071.0185 | 831 | 1016 |
| G7L.12aa.0087.0185 | 831 | 1017 |
| G7L.12aa.0090.0185 | 831 | 1018 |
| G7L.12aa.0120.0185 | 831 | 1019 |
| G7L.12aa.0157.0185 | 831 | 1020 |
| G7L.12aa.0089.001.0185 | 831 | 1021 |
| G7L.12aa.0089.005.0185 | 831 | 1022 |
| G7L.12aa.0089.006.0185 | 831 | 1023 |
| G7L.12aa.0089.007.0185 | 831 | 1024 |
| G7L.12aa.0089.0200 | 831 | 1025 |
| G7L.12aa.0019.0200 | 831 | 1026 |
| G7L.12aa.0020.0200 | 831 | 1027 |
| G7L.12aa.0069.0200 | 831 | 1028 |
| G7L.12aa.0071.0200 | 831 | 1029 |
| G7L.12aa.0087.0200 | 831 | 1030 |
| G7L.12aa.0090.0200 | 831 | 1031 |
| G7L.12aa.0120.0200 | 831 | 1032 |
| G7L.12aa.0157.0200 | 831 | 1033 |
| G7L.12aa.0089.001.0200 | 831 | 1034 |
| G7L.12aa.0089.005.0200 | 831 | 1035 |
| G7L.12aa.0089.006.0200 | 831 | 1036 |
| G7L.12aa.0089.007.0200 | 831 | 1037 |
| G7L.12aa.0089.0203 | 831 | 1038 |
| G7L.12aa.0019.0203 | 831 | 1039 |
| G7L.12aa.0020.0203 | 831 | 1040 |
| G7L.12aa.0069.0203 | 831 | 1041 |
| G7L.12aa.0071.0203 | 831 | 1042 |
| G7L.12aa.0087.0203 | 831 | 1043 |
| G7L.12aa.0090.0203 | 831 | 1044 |
| G7L.12aa.0120.0203 | 831 | 1045 |
| G7L.12aa.0157.0203 | 831 | 1046 |
| G7L.12aa.0089.001.0203 | 831 | 1047 |
| G7L.12aa.0089.005.0203 | 831 | 1048 |

TABLE 15-continued

Antibody Variants

| Name of antibody variant | SEQ ID NO: of heavy chain | SEQ ID NO: of light chain |
|---|---|---|
| G7L.12aa.0089.006.0203 | 831 | 1049 |
| G7L.12aa.0089.007.0203 | 831 | 1050 |

15-2 Evaluation of Protease Cleavage of Antibody Variants Harboring a Protease Cleavage Sequence The antibody variants prepared in 15-1 were tested to see whether they would be cleaved by protease treatment. The protease used was recombinant human u-Plasminogen Activator/Urokinase (human uPA, huPA) (R&D Systems; 1310-SE-010) or recombinant human Matriptase/ST14 Catalytic Domain (human MT-SP1, hMT-SP1) (R&D Systems; 3946-SE-010). The antibody variants were allowed to react for one hour under the conditions of 40 nM huPA or 3 nM hMT-SP1, 100 μg/mL antibody variant, PBS, and 37° C., and then subjected to capillary electrophoresis immunoassay. Wes (Protein Simple) was used for capillary electrophoresis immunoassay, and an anti-human lambda chain HRP-labeled antibody (abeam; ab9007) was used to detect light chains before and after cleavage. As a result, a peak of approximately 36 kDa that had been found prior to protease treatment disappeared, and a new peak appeared at approximately 20 kDa. This suggests that the peak of approximately 36 kDa was the uncleaved light chain of the antibody variant, and the peak of approximately 20 kDa was the cleaved light chain. The area of each peak obtained after protease treatment was output using software provided for Wes (Compass for SW; Protein Simple), and the cleavage ratio (%) of the antibody variant was determined with the following formula: (Peak area of cleaved light chain)×100/(Peak area of cleaved light chain+Peak area of uncleaved light chain). The cleavage ratios (%) of the antibody variants treated with huPA are shown in Table 16, and the cleavage ratios of the antibody variants treated with hMT-SP1 are shown in Table 17. Of the antibody variants shown in Tables 16 and 17 mentioned above, those with a higher cleavage ratio with huPA but a lower cleavage ratio with hMT-SP1, in other words, higher selectivity towards huPA, than G7L.106a.12aa (heavy chain: G7H-G1T4 (SEQ ID NO: 831), light chain: G7L.106a.12aa-LT0 (SEQ ID NO: 952)), are shown in Table 18.

TABLE 16

Cleavage Ratios of Antibody Variants (huPA)

| Name of antibody variant | Cleavage Ratio (%) |
|---|---|
| G7L.106a.12aa | 86.62 |
| G7L.12aa.0177 | 85.50 |
| G7L.12aa.0180 | 85.68 |
| G7L.12aa.0181 | 84.87 |
| G7L.12aa.0182 | 83.98 |
| G7L.12aa.0185 | 82.91 |
| G7L.12aa.0163 | 88.58 |
| G7L.12aa.0168 | 88.12 |
| G7L.12aa0089.0177 | 79.35 |
| G7L.12aa0019.0177 | 91.10 |
| G7L.12aa0020.0177 | 88.82 |
| G7L.12aa0069.0177 | 88.84 |
| G7L.12aa0071.0177 | 71.65 |
| G7L.12aa0087.0177 | 88.64 |
| G7L.12aa0090.0177 | 82.85 |
| G7L.12aa0120.0177 | 90.00 |

TABLE 16-continued

Cleavage Ratios of Antibody Variants (huPA)

| Name of antibody variant | Cleavage Ratio (%) |
|---|---|
| G7L.12aa0157.0177 | 77.83 |
| G7L.12aa0089.001.0177 | 79.68 |
| G7L.12aa0089.005.0177 | 91.36 |
| G7L.12aa0069.006.0177 | 86.39 |
| G7L.12aa0089.007.0177 | 86.52 |
| G7L.12aa0089.0180 | 82.10 |
| G7L.12aa0019.0180 | 82.83 |
| G7L.12aa0020.0180 | 89.09 |
| G7L.12aa0069.0180 | 85.85 |
| G7L.12aa0071.0180 | 85.87 |
| G7L.12aa0087.0180 | 87.87 |
| G7L.12aa0090.0180 | 87.52 |
| G7L.12aa0120.0180 | 83.14 |
| G7L.12aa0157.0180 | 87.37 |
| G7L.12aa0089.001.0180 | 78.29 |
| G7L.12aa0089.005.0180 | 85.47 |
| G7L.12aa0089.006.0180 | 87.50 |
| G7L.12aa0089.007.0180 | 90.07 |
| G7L.12aa0089.0181 | 82.88 |
| G7L.12aa0019.0181 | 89.53 |
| G7L.12aa0020.0181 | 88.63 |
| G7L.12aa0069.0181 | 84.37 |
| G7L.12aa0071.0181 | 87.39 |
| G7L.12aa0087.0181 | 86.12 |
| G7L.12aa0090.0181 | 78.62 |
| G7L.12aa0120.0181 | 77.98 |
| G7L.12aa0157.0181 | 79.61 |
| G7L.12aa0089.001.0181 | 89.18 |
| G7L.12aa0089.005.0181 | 90.12 |
| G7L.12aa0089.006.0181 | 89.92 |
| G7L.12aa0089.007.0181 | 91.27 |
| G7L.12aa0089.0182 | no data |
| G7L.12aa0019.0182 | 87.05 |
| G7L.12aa0020.0182 | 90.72 |
| G7L.12aa0069.0182 | 89.73 |
| G7L.12aa0071.0182 | 82.75 |
| G7L.12aa0087.0182 | 85.02 |
| G7L.12aa0090.0182 | 81.94 |
| G7L.12aa0120.0182 | 80.22 |
| G7L.12aa0157.0182 | 78.22 |
| G7L.12aa0089.001.0182 | 83.32 |
| G7L.12aa0089.005.0182 | 84.25 |
| G7L.12aa0089.006.0182 | 86.29 |
| G7L.12aa0089.007.0182 | 90.06 |
| G7L.12aa0089.0185 | 78.36 |
| G7L.12aa0019.0185 | no data |
| G7L.12aa0020.0185 | no data |
| G7L.12aa0069.0185 | 75.99 |
| G7L.12aa0071.0185 | 82.77 |
| G7L.12aa0087.0185 | 72.78 |
| G7L.12aa0090.0185 | 82.67 |
| G7L.12aa0120.0185 | no data |
| G7L.12aa0157.0185 | 65.10 |
| G7L.12aa0089.001.0185 | 84.78 |
| G7L.12aa0089.005.0185 | 89.84 |
| G7L.12aa0089.006.0185 | 88.54 |
| G7L.12aa0089.007.0185 | 84.01 |
| G7L.12aa0089.0200 | 85.19 |
| G7L.12aa0019.0200 | 89.15 |
| G7L.12aa0020.0200 | 62.65 |
| G7L.12aa0069.0200 | 63.60 |
| G7L.12aa0071.0200 | 65.05 |
| G7L.12aa0087.0200 | 78.18 |
| G7L.12aa0090.0200 | 76.34 |
| G7L.12aa0120.0200 | 55.63 |
| G7L.12aa0157.0200 | 51.04 |
| G7L.12aa0069.001.0200 | 86.49 |
| G7L.12aa0089.005.0200 | 36.47 |
| G7L.12aa0089.006.0200 | 47.77 |
| G7L.12aa0089.007.0200 | 20.50 |
| G7L.12aa0069.0203 | 25.62 |
| G7L.12aa0019.0203 | 26.52 |
| G7L.12aa0020.0203 | 17.24 |
| G7L.12aa0069.0203 | 28.03 |
| G7L.12aa0071.0203 | 9.75 |

TABLE 16-continued

Cleavage Ratios of Antibody Variants (huPA)

| Name of antibody variant | Cleavage Ratio (%) |
|---|---|
| G7L.12aa0087.0203 | 76.83 |
| G7L.12aa0090.0203 | 71.98 |
| G7L.12aa0120.0203 | 55.44 |
| G7L.12aa0157.0203 | 40.79 |
| G7L.12aa0089.001.0203 | 60.70 |
| G7L.12aa0089.005.0203 | 67.48 |
| G7L.12aa0089.006.0203 | 80.67 |
| G7L.12aa0069.007.0203 | 71.85 |

TABLE 17

Cleavage Ratios of Antibody Variants (hMT-SP1)

| Name of antibody variant | Cleavage Ratio (%) |
|---|---|
| G7L.106a.12aa | 65.07 |
| G7L.12aa.0177 | 21.86 |
| G7L.12aa.0180 | 28.97 |
| G7L.12aa.0181 | 21.72 |
| G7L.12aa.0182 | 28.23 |
| G7L.12aa.0185 | 28.51 |
| G7L.12aa.0163 | 25.57 |
| G7L.12aa.0166 | 25.26 |
| G7L.12aa0089.0177 | 32.38 |
| G7L.12aa0019.0177 | 28.38 |
| G7L.12aa0020.0177 | 28.29 |
| G7L.12aa0069.0177 | 28.21 |
| G7L.12aa0071.0177 | 34.08 |
| G7L.12aa0087.0177 | 23.11 |
| G7L.12aa0090.0177 | 29.23 |
| G7L.12aa0120.0177 | 46.73 |
| G7L.12aa0157.0177 | 20.36 |
| G7L.12aa0089.001.0177 | 25.70 |
| G7L.12aa0089.005.0177 | 24.04 |
| G7L.12aa0089.006.0177 | 22.70 |
| G7L.12aa0089.007.0177 | 36.20 |
| G7L.12aa0089.0180 | 45.07 |
| G7L.12aa0019.0180 | 32.04 |
| G7L.12aa0020.0180 | 41.31 |
| G7L.12aa0069.0180 | 40.60 |
| G7L.12aa0071.0180 | 45.66 |
| G7L.12aa0087.0180 | 25.55 |
| G7L.12aa0090.0180 | 35.34 |
| G7L.12aa0120.0180 | 53.56 |
| G7L.12aa0157.0180 | 22.47 |
| G7L.12aa0089.001.0180 | 39.90 |
| G7L.12aa0089.005.0180 | 33.85 |
| G7L.12aa0089.006.0180 | 30.45 |
| G7L.12aa0089.007.0180 | 37.62 |
| G7L.12aa0089.0181 | 26.58 |
| G7L.12aa0019.0181 | 22.14 |
| G7L.12aa0020.0181 | 32.03 |
| G7L.12aa0069.0181 | 32.43 |
| G7L.12aa0071.0181 | 32.62 |
| G7L.12aa0087.0181 | 21.48 |
| G7L.12aa0090.0181 | 16.56 |
| G7L.12aa0120.0181 | 39.48 |
| G7L.12aa0157.0181 | 19.49 |
| G7L.12aa0089.001.0181 | 24.62 |
| G7L.12aa0069.005.0181 | 25.49 |
| G7L.12aa0069.006.0181 | 23.08 |
| G7L.12aa0089.007.0181 | 31.00 |
| G7L.12aa0089.0182 | no data |
| G7L.12aa0019.0182 | 22.43 |
| G7L.12aa0020.0182 | 26.16 |
| G7L.12aa0069.0182 | 29.41 |
| G7L.12aa0071.0182 | 25.14 |
| G7L.12aa0087.0182 | 19.97 |
| G7L.12aa0090.0182 | 29.72 |
| G7L.12aa0120.0182 | 36.65 |
| G7L.12aa0157.0182 | 19.55 |
| G7L.12aa0089.001.0182 | 28.63 |
| G7L.12aa0069.005.0182 | 23.62 |
| G7L.12aa0069.006.0182 | 21.62 |
| G7L.12aa0089.007.0182 | 19.79 |
| G7L.12aa0089.0185 | 25.62 |
| G7L.12aa0019.0185 | no data |
| G7L.12aa0020.0185 | no data |
| G7L.12aa0069.0185 | 24.64 |
| G7L.12aa0071.0185 | 27.25 |
| G7L.12aa0067.0185 | 17.84 |
| G7L.12aa0090.0185 | 27.38 |
| G7L.12aa0120.0185 | no data |
| G7L.12aa0157.0185 | 12.66 |
| G7L.12aa0089.001.0185 | 17.98 |
| G7L.12aa0069.005.0185 | 14.92 |
| G7L.12aa0089.006.0185 | 15.74 |
| G7L.12aa0089.007.0185 | 21.96 |
| G7L.12aa0089.0200 | 26.28 |
| G7L.12aa0019.0200 | 9.02 |
| G7L.12aa0020.0200 | 12.71 |
| G7L.12aa0069.0200 | 14.34 |
| G7L.12aa0071.0200 | 15.10 |
| G7L.12aa0087.0200 | 14.19 |
| G7L.12aa0090.0200 | 21.19 |
| G7L.12aa0120.0200 | 23.76 |
| G7L.12aa0157.0200 | 8.25 |
| G7L.12aa0089.001.0200 | 21.45 |
| G7L.12aa0089.005.0200 | 16.97 |
| G7L.12aa0089.006.0200 | 12.93 |
| G7L.12aa0089.007.0200 | 17.33 |
| G7L.12aa0089.0203 | 10.82 |
| G7L.12aa0019.0203 | 0.21 |
| G7L.12aa0020.0203 | 6.37 |
| G7L.12aa0069.0203 | 11.43 |
| G7L.12aa0071.0203 | 0.61 |
| G7L.12aa0087.0203 | 11.18 |
| G7L.12aa0090.0203 | 8.63 |
| G7L.12aa0120.0203 | 22.68 |
| G7L.12aa0157.0203 | 7.00 |
| G7L.12aa0089.001.0203 | 16.46 |
| G7L.12aa0089.005.0203 | 14.89 |
| G7L.12aa0089.006.0203 | 13.98 |
| G7L.12aa0089.007.0203 | 19.83 |

TABLE 18

Antibody Variants

| Name of antibody variant | SEQ ID NO of heavy chain | SEQ ID NO of light chain |
|---|---|---|
| G7L.12aa0163 | 831 | 958 |
| G7L.12aa0166 | 831 | 959 |
| G7L.12aa0019.0177 | 831 | 961 |
| G7L.12aa0020.0177 | 831 | 962 |
| G7L.12aa0069.0177 | 831 | 963 |
| G7L.12aa0087.0177 | 831 | 965 |
| G7L.12aa0120.0177 | 831 | 967 |
| G7L.12aa0089.005.0177 | 831 | 970 |
| G7L.12aa0089.006.0177 | 831 | 971 |
| G7L.12aa0020.0180 | 831 | 975 |
| G7L.12aa0087.0180 | 831 | 978 |
| G7L.12aa0090.0180 | 831 | 979 |
| G7L.12aa0157.0180 | 831 | 981 |
| G7L.12aa0089.006.0180 | 831 | 984 |
| G7L.12aa0089.007.0180 | 831 | 985 |
| G7L.12aa0019.0181 | 831 | 987 |
| G7L.12aa0020.0181 | 831 | 988 |
| G7L.12aa0071.0181 | 831 | 990 |
| G7L.12aa0087.0181 | 831 | 991 |
| G7L.12aa0089.001.0181 | 831 | 995 |
| G7L.12aa0089.005.0181 | 831 | 996 |

TABLE 18-continued

Antibody Variants

| Name of antibody variant | SEQ ID NO of heavy chain | SEQ ID NO of light chain |
|---|---|---|
| G7L.12aa0089.006.0181 | 831 | 997 |
| G7L.12aa0089.007.0181 | 831 | 998 |
| G7L.12aa0019.0182 | 831 | 1000 |
| G7L.12aa0020.0182 | 831 | 1001 |
| G7L.12aa0069.0182 | 831 | 1002 |
| G7L.12aa0089.007.0182 | 831 | 1011 |
| G7L.12aa0089.005.0185 | 831 | 1022 |
| G7L.12aa0089.006.0185 | 831 | 1023 |
| G7L.12aa0019.0200 | 831 | 1026 |

Example 16 In Vivo Cleavage Evaluation of Antibody Variants Harboring Various Protease Cleavage Sequences 16-1 Preparation of Bispecific Antibodies Harboring Protease Cleavage Sequences The protease cleavage sequences shown in Table 19 were inserted near the boundary between the light chain variable region and constant region of antibodies (parent antibodies) having the heavy chain of SEQ ID NO: 1051 and the light chain of SEQ ID NO: 832 to prepare light chain variants harboring different protease cleavage sequences (Table 20).

The light chain variants harboring the protease cleavage sequence prepared as described above and the light chain of SEQ ID NO: 832 were combined with the heavy chain of SEQ ID NO: 1051, and the antibody variants shown in Table 21 were transiently expressed using Expi293 cells (Life Technologies) according to a method known to those skilled in the art, and purified according to a method known to those skilled in the art using protein A.

In addition, an antibody against keyhole limpet hemocyanin, MabKLHn (heavy chain: IC17HdK-F760mnN17 (SEQ ID NO: 1390), light chain: IC17L-k0 (SEQ ID NO: 1391)), was also transiently expressed using Expi293 cells (Life technologies) according to a method known to those skilled in the art, and purified using Protein A according to a method known to those skilled in the art.

MabKLHn was mixed with the antibody variants shown in Table 21 or with the parent antibody having the heavy chain of SEQ ID NO: 1051 and the light chain of SEQ ID NO: 832 to prepare the bispecific antibodies shown in Table 22 by the method described in WO 2015046467.

TABLE 19

| SEQ ID NO | Protease Cleavage Sequences<br>Cleavage sequence |
|---|---|
| 1052 | TSYTGRSAVPRG |
| 1053 | TSYSGRSAVVRG |
| 1054 | TSYTGRSAVYRG |
| 1055 | TSYTGRSAVHRG |

TABLE 20

Light Chain Variants

| SEQ ID NO | Name of light chain variant |
|---|---|
| 1056 | G7L.12aa0089.001-LT0 |
| 1057 | G7L.12aa0089.003-LT0 |
| 1058 | G7L.12aa0089.005-LT0 |
| 1059 | G7L.12aa0089.007-LT0 |

TABLE 21

Antibody Variants

| Name of antibody variant | SEQ ID NO of heavy chain | SEQ ID NO of light chain |
|---|---|---|
| G7L.12aa0089.001 | 1051 | 1056 |
| G7L.12aa0089.003 | 1051 | 1057 |
| G7L.12aa0089.005 | 1051 | 1058 |
| G7L.12aa0089.007 | 1051 | 1059 |

TABLE 22

Bispecific Antibodies

| Name of bispecific antibody | Antibody variant | | Anti-KLH antibody | |
|---|---|---|---|---|
| | SEQ ID NO of heavy chain | SEQ ID NO of light chain | SEQ ID NO of heavy chain | SEQ ID NO of light chain |
| G7//KLH | 1051 | 832 | 1060 | 1061 |
| G7L.12aa0089.001//KLH | 1051 | 1056 | 1060 | 1061 |
| G7L.12aa0089.003//KLH | 1051 | 1057 | 1060 | 1061 |
| G7L.12aa0089.005//KLH | 1051 | 1058 | 1060 | 1061 |
| G7L.12aa0089.007//KLH | 1051 | 1059 | 1060 | 1061 |

16-2 Production of a Cell Line Stably Expressing Protease

B16F10/chGPC3/muPA was used as a protease stable expression cell line to be transplanted into mice. This cell line was produced by introducing a modified mouse chimeric Glypican 3 (chGPC3) gene and a mouse uPA (muPA: NM_008873) gene into a mouse melanoma cell line, B16F10, and establishing and then cloning a stably expressing cell line. B16F10/chGPC3/muPA cells were cultured in RPMI1640 medium (Nacalai Tesque) containing 10% FBS (SIGMA), 0.5 mg/mL Geneticin (Gibco), and 1.5 µg/mL Puromycin (Gibco).

16-3 Production of a Syngeneic Tumor Line-Transplanted Mouse Model

The animals used for transplant were C57BL/6NCrl mice (six weeks old, female) purchased from Charles River Laboratories. B16F10/chGPC3/muPA cells were transplanted subcutaneously into C57BL/6NCrl mice (1E6 cells per animal). When the average volume of the transplanted tumor reached about 200 mm$^3$ to 300 mm$^3$, the mice were used as model mice to which a variant antibody was administered.

The volume of the tumor graft was calculated with the following formula:

Tumor volume=long diameter×short diameter×short diameter/2

16-4 Preparation of Agents to be Administered

The antibody variants harboring the protease cleavage sequences shown in Table 22 produced in Example 16-1, were used as agents to be administered to the B16F10/chGPC3/muPA cell-transplanted model mice. The agents to be administered were prepared using PBST-buffer (PBS+ 0.05% Tween20 buffer) such that the concentration of the variant antibody was 0.1 mg/mL.

16-5 Administration Test of Antibody Variants in Order to Evaluate Protease Cleavage After 11 days of transplant, the B16F10/chGPC3/muPA cell-transplanted mice were given five antibody variant samples harboring different protease cleavage sequences via the tail vein at a dose of 1 mg/kg (mg administered antibody per kg mouse body weight). The names of antibody variants, doses, administration methods, and other details in the administration test are shown in Table 23.

TABLE 23

Summary of the Mouse Administration Tests

| Group | Number of animals | Pharmaceutical agent | Dose | Administration method | Day of administration |
|---|---|---|---|---|---|
| 1 | 3 | G7//KLH | 1 mg/kg | Tail vein | 11th day after transplantation |
| 2 | 3 | G7L.12aa0089.001//KLH | 1 mg/kg | Tail vein | 11th day after transplantation |
| 3 | 3 | G7L.12aa0089.003//KLH | 1 mg/kg | Tail vein | 11th day after transplantation |
| 4 | 3 | G7L.12aa0089.005//KLH | 1 mg/kg | Tail vein | 11th day after transplantation |
| 5 | 3 | G7L.12aa0089.007//KLH | 1 mg/kg | Tail vein | 11th day after transplantation |

16-6 Orbital Blood Collection from B16F10/chGPC3/muPA Cell-Transplanted Model Mice On days 1 and 3 after administration of the antibody variant, blood was collected from the eye socket of the B16F10/chGPC3/muPA cell-transplanted model mice. The blood collection was carried out under isoflurane anesthesia. Collected blood was centrifuged at 1,900×g, 4° C. for ten minutes. After the centrifugation, the supernatant was obtained as plasma components and stored at −30° C.

16-7 Evaluation of Cleavage of Administered Antibodies Collected from Mice

Figure 31:
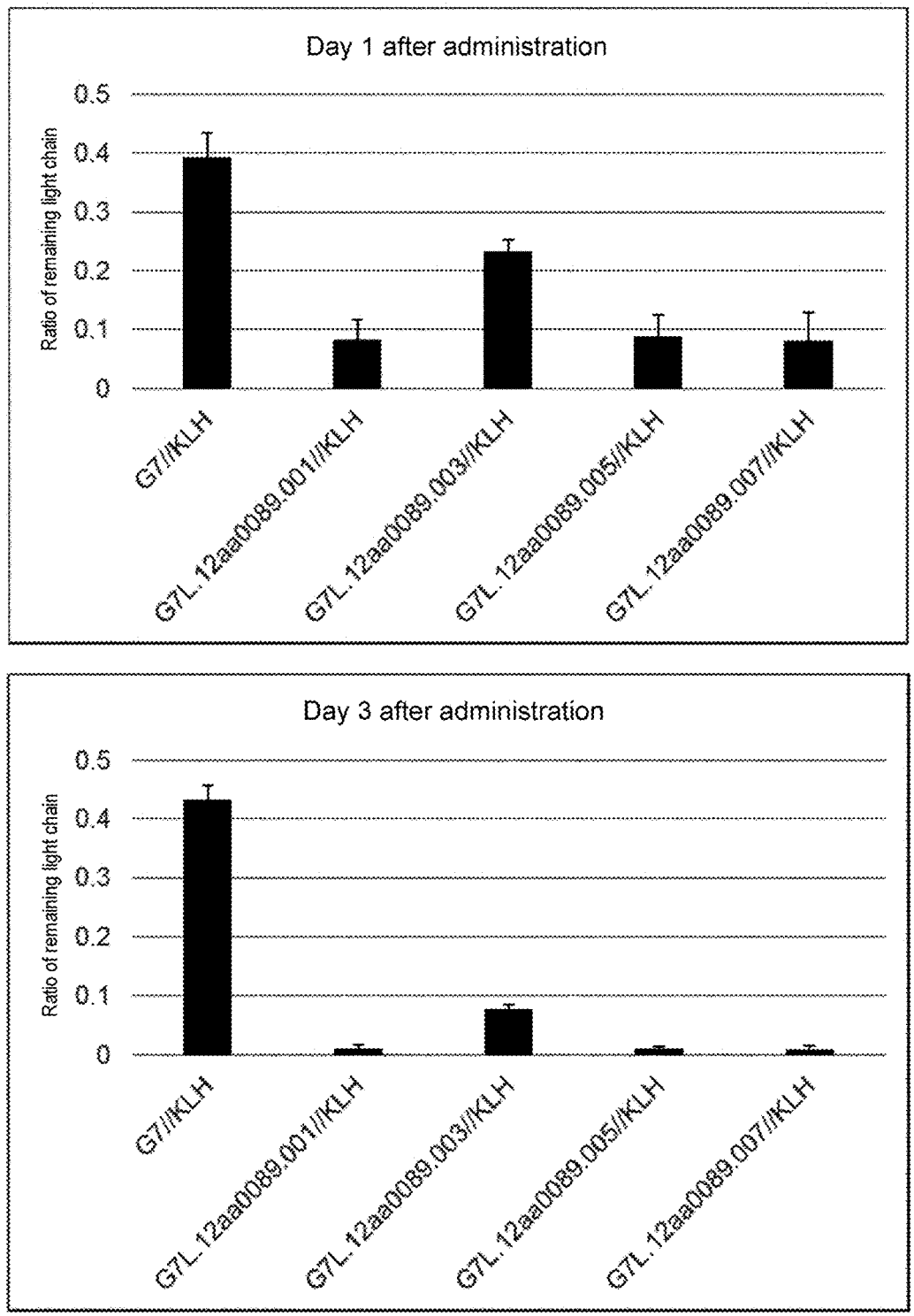
FIG. 31 is a diagram showing the evaluation of the cleavage efficiency in vivo when an antibody molecule into which a protease cleavage sequence has been inserted was administered to mice.

Antibodies were purified from the plasma collected in Example 16-6 using Dynabeads Protein A (Thermo; 10001D) according to a method known to those skilled in the art, and subjected to capillary electrophoresis immunoassay in order to evaluate the efficiency of protease cleavage of the antibody variants. Wes (Protein Simple) was used for capillary electrophoresis immunoassay. To detect the antibody light chain, an anti-human lambda chain HRP-labeled antibody (abcam; ab9007) was used. To detect the antibody heavy chain, an anti-human heavy chain HRP-labeled antibody (Protein Simple; 043-491) was used. As a result, a peak of the uncleaved, full-length light chain was detected at approximately 36 kDa with the anti-human lambda chain antibody, and a peak of the full-length heavy chain was detected at approximately 56 kDa with the anti-human heavy chain antibody. The light chain of MabKLHn is a kappa chain, which is not detected with the anti-human lambda chain antibody. Therefore, the anti-human lambda chain antibody can be used to evaluate the cleavage efficiency of the light chain harboring a protease cleavage sequence. The area of each peak obtained by capillary electrophoresis immunoassay was output using software provided for Wes (Compass for SW; Protein Simple), and the ratio of the remaining light chain was calculated as [Peak area of light chain]/[Peak area of heavy chain] to determine the ratio of the full-length light chain that remained uncleaved in the mouse body. The ratios of the remaining light chain of the antibodies collected one day and three days after being administered to mice are shown in FIG. 31. As a result, the antibody variants harboring the protease cleavage sequence shown in Table 21 were found to have a lower remaining light chain ratio than the parent antibody having the heavy chain of SEQ ID NO: 1051 and the light chain of SEQ ID NO: 832 in the body of the tumor-transplanted mice. That is, it was shown that the light chains harboring a protease cleavage sequence were efficiently cleaved in vivo in the tumor-transplanted mice.

Reference Example 1 Preparation of Biotinylated Plexin A1

Biotinylated Plexin A1 (also referred to as biotin-labeled human Plexin A1) was prepared by a method known to those skilled in the art. Specifically, a gene fragment encoding a specific sequence (AviTag sequence; SEQ ID NO: 36) to be biotinylated by biotin ligase and a gene fragment encoding a FLAG tag sequence (SEQ ID NO: 199; DYKDDDDK) were linked via a gene fragment encoding a linker constituted by glycine and serine to downstream of a gene fragment encoding the extracellular region of Plexin A1. A gene fragment encoding a protein containing Plexin A1 linked to the AviTag sequence and the FLAG tag sequence (SEQ ID NO: 200) was integrated to a vector for expression in animal cells. The constructed plasmid vector was transfected into FreeStyle 293 cells (Invitrogen Corp.) using 293Fectin (Invitrogen Corp.). In this operation, the cells were cotransfected with a gene for EBNA1 (SEQ ID NO: 57) expression and a gene for biotin ligase (BirA; SEQ ID NO: 58) expression, and biotin was further added thereto for the purpose of biotin-labeling Plexin A1. The cells transfected according to the procedures mentioned above were cultured at 37° C. under 8% $CO_2$ and caused to secrete the protein of interest (biotinylated Plexin A1) into the culture supernatant. This cell culture solution was filtered through a 0.22 m bottle-top filter to obtain a culture supernatant.

A column was packed with Anti FLAG M2 agarose (Sigma-Aldrich Co. LLC, #A2220) to prepare a FLAG column. The FLAG column was equilibrated in advance with D-PBS(−). The culture supernatant was applied thereto to bind the biotinylated Plexin A1 to the column. Subsequently, the biotinylated Plexin A1 was eluted using FLAG peptide dissolved in D-PBS(−). Aggregates were removed from this eluate by gel filtration chromatography using HiLoad 26/600 Superdex 200 μg, 320 mL (GE Healthcare Japan Corp., 28-9893-36) to obtain purified biotinylated Plexin A1.

The embodiments of the invention mentioned above are described in detail with reference to actual examples and illustrated examples with the aim of helping clear understanding. However, the description and illustration in the present specification should not be interpreted as limiting the scope of the present invention. The disclosure of all patent literatures and scientific literatures cited herein is explicitly incorporated herein by reference in its entirety.

INDUSTRIAL APPLICABILITY

The polypeptides of the present invention comprising an antigen-binding domain and a carrying moiety having a longer half-life in blood than that of the antigen-binding domain and having an inhibiting domain that inhibits the binding activity of the antigen-binding domain, and pharmaceutical compositions comprising the polypeptide can transport the antigen-binding domain in blood while inhibited the antigen-binding activity of the antigen-binding domain. Also, use of the polypeptide of the present invention can allow the antigen-binding domain to exert its antigen-binding activity specifically at disease sites. Furthermore, since the antigen-binding domain has a shorter half-life at the time of exerting its antigen-binding activity than at the time of transport, the risk of acting systemically is decreased. Thus, the polypeptides and the pharmaceutical compositions of the present invention are very useful in the treatment of diseases.

A single-domain antibody whose antigen-binding activity is inhibited by its association with particular VL, VH or VHH can be screened for or produced as one example of the antigen-binding domain to thereby efficiently produce the polypeptide of the present invention. Furthermore, necessary antigen-binding domains can be efficiently obtained when the polypeptide of the present invention is prepared by use of a library including the single-domain antibody whose antigen-binding activity is inhibited by its association with particular VL, VH or VHH, as one example of the antigen-binding domain that can be used in the polypeptides of the present invention.

SEQUENCE LISTING (1090 sequences)

SEQ ID NO: 1 - protein, 127 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 2 - protein, 455 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 3 - protein, 214 aa, Artificial sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4 - protein, 219 aa, Artificial sequence
  an artificially synthesized sequence
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQRLHWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5 - protein, 215 aa, Artificial sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGRSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6 - protein, 217 aa, Artificial sequence
  an artificially synthesized sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDNSLNAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7 - protein, 216 aa, Artificial sequence
  an artificially synthesized sequence
QSVLTQPPSASGTPGQRVTISCSGSSSNIGSNTVNWYQQLPGTAPKLLIYSNNQRPSGVPDRFSGSKSGTSASLAISGLQSEDEADYYCGTWDGGVTGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8 - protein, 217 aa, Artificial sequence
  an artificially synthesized sequence
QSALTQPASVSGSPGQSITISCTGTSSDVGGYNYVSWYQQHPGKAPKLMIYEVSNRPSGVSNRFSGSKSGNTASLTISGLQAEDEADYYCSSYRSGYTLVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 9 - protein, 213 aa, Artificial sequence
  an artificially synthesized sequence
SYVLTQPPSVSVAPGKTARITCGGNNIGSKSVHWYQQKPGQAPVLVIYYDSDRPSGIPERFSGSNSGNTATLTISRVEAGDEADYYCQAWDSSTDVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 10 - protein, 107 aa, Homo sapiens [sequence omitted]

SEQ ID NO: 11 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 12 - protein, 8 aa, Artificial sequence
  an artificially synthesized sequence
LSGRSDNH

SEQ ID NO: 13 - protein, 463 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSASLSGRSDNHTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 14 - protein, 473 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSASSGGSGLSGRSDNHGSSGGTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 15 - protein, 464 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVLSGRSDNHGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 16 - protein, 473 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 17 - protein, 464 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSASTKLSGRSDNHGGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 18 - protein, 473 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSASTKSGGSGLSGRSDNHGSSGGGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 19 - protein, 121 aa, Artificial sequence [sequence omitted]

SEQ ID NO: 20 - protein, 121 aa, Artificial sequence
  an artificially synthesized sequence
EVQLVESGGGLVQPGGSLRLSCAASGSVFKINVMAWVRQAPGKGLEWVAGIISGGSTSYADSVKGRFTISRDNAKNTLYLQMNSLRPEDTAVYYCAFITTESDYDLGRRYWGQGTLVTVSS

SEQ ID NO: 21 - protein, 330 aa, Homo sapiens [sequence omitted]

SEQ ID NO: 22 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 23 - protein, 377 aa, Homo sapiens
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 24 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 25 - protein, 6 aa, Artificial sequence
  an artificially synthesized sequence
PLGLAG

SEQ ID NO: 26 - protein, 8 aa, Artificial sequence
  an artificially synthesized sequence
VPLSLTMG

SEQ ID NO: 27 - protein, 5 aa, Artificial sequence
  an artificially synthesized sequence
GSGGS

SEQ ID NO: 28 - protein, 4 aa, Artificial sequence
  an artificially synthesized sequence
GGGS

SEQ ID NO: 29 - protein, 4 aa, Artificial sequence
  an artificially synthesized sequence
GGSG

SEQ ID NO: 30 - protein, 5 aa, Artificial sequence
  an artificially synthesized sequence
GGSGG

SEQ ID NO: 31 - protein, 5 aa, Artificial sequence
  an artificially synthesized sequence
GSGSG

SEQ ID NO: 32 - protein, 5 aa, Artificial sequence
  an artificially synthesized sequence
GSGGG

SEQ ID NO: 33 - protein, 5 aa, Artificial sequence
  an artificially synthesized sequence
GGGSG

SEQ ID NO: 34 - protein, 5 aa, Artificial sequence
  an artificially synthesized sequence
GSSSG

SEQ ID NO: 35 - protein, 338 aa, Homo sapiens
LAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQ

SEQ ID NO: 36 - protein, 15 aa, Artificial sequence
  an artificially synthesized sequence
GLNDIFEAQKIEWHE

SEQ ID NO: 37 - protein, 358 aa, Artificial sequence
  an artificially synthesized sequence
LAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQGGGGSGLNDIFEAQKIEWHE

SEQ ID NO: 38 - protein, 449 aa, Artificial sequence
  an artificially synthesized sequence
EVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 39 - protein, 449 aa, Artificial sequence
  an artificially synthesized sequence
EVQLVESGGGLVQPGGSLRLSCAASGSVFKINVMAWVRQAPGKGLEWVAGIISGGSTSYADSVKGRFTISRDNAKNTLYLQMNSLRPEDTAVYYCAFITTESDYDLGRRYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 40 - protein, 457 aa, Artificial sequence
  an artificially synthesized sequence
EVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSASLSGRSDNHTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 41 - protein, 467 aa, Artificial sequence
  an artificially synthesized sequence
EVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSASSGGSGLSGRSDNHGSSGGTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 42 - protein, 467 aa, Artificial sequence
  an artificially synthesized sequence
EVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 43 - protein, 467 aa, Artificial sequence
  an artificially synthesized sequence
EVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSASTKSGGSGLSGRSDNHGSSGGGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 44 - protein, 18 aa, Artificial sequence
  an artificially synthesized sequence
SGGSGLSGRSDNHGSSGG

SEQ ID NO: 45 - protein, 9 aa, Artificial sequence
  an artificially synthesized sequence
LSGRSDNHG

SEQ ID NO: 46 - protein, 4 aa, Artificial sequence
  an artificially synthesized sequence
GSGG

SEQ ID NO: 47 - protein, 4 aa, Artificial sequence
  an artificially synthesized sequence
SGGG

SEQ ID NO: 48 - protein, 4 aa, Artificial sequence
  an artificially synthesized sequence
GSSG

SEQ ID NO: 49 - protein, 5 aa, Artificial sequence
  an artificially synthesized sequence
GGGGS

SEQ ID NO: 50 - protein, 6 aa, Artificial sequence
  an artificially synthesized sequence
GGGGGS

SEQ ID NO: 51 - protein, 5 aa, Artificial sequence
  an artificially synthesized sequence
SGGGG

SEQ ID NO: 52 - protein, 5 aa, Artificial sequence
  an artificially synthesized sequence
GSSGG

SEQ ID NO: 53 - protein, 5 aa, Artificial sequence
  an artificially synthesized sequence
SGGSG

SEQ ID NO: 54 - protein, 6 aa, Artificial sequence
  an artificially synthesized sequence
SGGGGG

SEQ ID NO: 55 - protein, 7 aa, Artificial sequence
  an artificially synthesized sequence
GGGGGGS

SEQ ID NO: 56 - protein, 7 aa, Artificial sequence
  an artificially synthesized sequence
SGGGGGG

SEQ ID NO: 57 - protein, 641 aa, Epstein-Barr virus (EBV)
MSDEGPGTGPGNGLGEKGDTSGPEGSGGSGPQRRGGDNHGRGRGRGRGRGGGRPGAPGGSGSGPRHRDGVRRPQKRPSCIGCKGTHGGTGAGAGAGGAGAGGAGAGGGAGAGGGAGGAGGAGGAGAGGGAGAGGGAGGAGGAGAGGGAGAGGGAGGAGAGGGAGGAGGAGAGGGAGAGGGAGGAGAGGGAGGAGGAGAGGGAGAGGAGGAGGAGAGGAGAGGGAGGAGGAGAGGAGAGGAGAGGAGAGGAGGAGAGGAGGAGAGGAGGAGAGGGAGGAGAGGGAGGAGAGGAGGAGAGGAGGAGAGGAGGAGAGGGAGAGGAGAGGGGRGRGGSGGRGRGGSGGRGRGGSGGRRGRGRERARGGSRERARGRGRGRGEKRPRSPSSQSSSSGSPPRRPPPGRRPFFHPVGEADYFEYHQEGGPDGEPDVPPGAIEQGPADDPGEGPSTGPRGQGDGGRRKKGGWFGKHRGQGGSNPKFENIAEGLRALLARSHVERTTDEGTWVAGVFVYGGSKTSLYNLRRGTALAIPQCRLTPLSRLPFGMAPGPGPQPGPLRESIVCYFMVFLQTHIFAEVLKDAIKDLVMTKPAPTCNIRVTVCSFDDGVDLPPWFPPMVEGAAAEGDDGDDGDEGGDGDEGEEGQE

SEQ ID NO: 58 - protein, 321 aa, Escherichia coli
MKDNTVPLKLIALLANGEFHSGEQLGETLGMSRAAINKHIQTLRDWGVDVFTVPGKGYSLPEPIQLLNAKQILGQLDGGSVAVLPVIDSTNQYLLDRIGELKSGDACIAEYQQAGRGRRGRKWFSPFGANLYLSMFWRLEQGPAAAIGLSLVIGIVMAEVLRKLGADKVRVKWPNDLYLQDRKLAGILVELTGKTGDAAQIVIGAGINMAMRRVEESVVNQGWITLQEAGINLDRNTLAAMLIRELRAALELFEQEGLAPYLSRWEKLDNFINRPVKLIIGDKEIFGISRGIDKQGALLLEQDGIIKPWMGGEISLRSAEK

SEQ ID NO: 59 - protein, 373 aa, Artificial sequence
  an artificially synthesized sequence
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDDIEGRMDPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSGGSGENLYFQGSGGGLNDIFEAQKIEWHE

SEQ ID NO: 60 - protein, 323 aa, Artificial sequence
  an artificially synthesized sequence
FKIPIEELEDRVFVNCNTSITWVEGTVGTLLSDITRLDLGKRILDPRGIYRCNGTDIYKDKESTVQVHYRMCQSCVELDDIEGRMDPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 61 - protein, 123 aa, Vicugna pacos
QVQLVESGGGLVQPGGSLRLSCAASGFTFNHCWMYWVRQAPGKGLEWVSVINTDGGSAYYADSVKGRFTISRDNAKNTLYLQMNSLKSEDTAVYYCARDWAPLVDYYYGMDYWGKGTLVTVSG

SEQ ID NO: 62 - protein, 121 aa, Vicugna pacos
QVQLVESGGGLVQPGGSLRLSCAASGFPFDNYVMSWVRQAPGKGLEWISAISWNGGSTYYAESMKGRFTISRDNAKSTLYLQMNSLKSEDTAVYYCAKEPRVYYSGSPDYWGQGTQVTVSG

SEQ ID NO: 63 - protein, 118 aa, Vicugna pacos
QVQLVESGGGLVQPGGSLRLSCAASGFTFDVYGMSWVRHSPGKGLEWVSTINWNGGSTYYAESMKGRFTISRDNAKNTVYLQMNSLKPEDTAVYYCAKFAPWDGDMEWGQGTQVTVSG

SEQ ID NO: 64 - protein, 469 aa, Artificial sequence
  an artificially synthesized sequence
QVQLVESGGGLVQPGGSLRLSCAASGFTFNHCWMYWVRQAPGKGLEWVSVINTDGGSAYYADSVKGRFTISRDNAKNTLYLQMNSLKSEDTAVYYCARDWAPLVDYYYGMDYWGKGTLVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 65 - protein, 467 aa, Artificial sequence
  an artificially synthesized sequence
QVQLVESGGGLVQPGGSLRLSCAASGFPFDNYVMSWVRQAPGKGLEWISAISWNGGSTYYAESMKGRFTISRDNAKSTLYLQMNSLKSEDTAVYYCAKEPRVYYSGSPDYWGQGTQVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 66 - protein, 464 aa, Artificial sequence
  an artificially synthesized sequence
QVQLVESGGGLVQPGGSLRLSCAASGFTFDVYGMSWVRHSPGKGLEWVSTINWNGGSTYYAESMKGRFTISRDNAKNTVYLQMNSLKPEDTAVYYCAKFAPWDGDMEWGQGTQVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 67 - protein, 222 aa, Artificial sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVELSGRSDNHIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 68 - protein, 222 aa, Artificial sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVEILSGRSDNHKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 69 - protein, 222 aa, Artificial sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVEIKLSGRSDNHRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 70 - protein, 222 aa, Artificial sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVEIKRTLSGRSDNHVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 71 - protein, 222 aa, Artificial sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVEIKRTVLSGRSDNHAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 72 - protein, 222 aa, Artificial sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVEIKRTVALSGRSDNHAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 73 - protein, 222 aa, Artificial sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVEIKRTVAALSGRSDNHPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 74 - protein, 12 aa, Artificial sequence
  an artificially synthesized sequence
TSTSGRSANPRG

SEQ ID NO: 75 - protein, 13 aa, Artificial sequence
  an artificially synthesized sequence
ISSGLLSGRSDNH

SEQ ID NO: 76 - protein, 18 aa, Artificial sequence
  an artificially synthesized sequence
AVGLLAPPGGLSGRSDNH

SEQ ID NO: 77 - protein, 13 aa, Artificial sequence
  an artificially synthesized sequence
GAGVPMSMRGGAG

SEQ ID NO: 78 - protein, 13 aa, Artificial sequence
  an artificially synthesized sequence
GAGIPVSLRSGAG

SEQ ID NO: 79 - protein, 8 aa, Artificial sequence
  an artificially synthesized sequence
GPLGIAGQ

SEQ ID NO: 80 - protein, 10 aa, Artificial sequence
  an artificially synthesized sequence
GGPLGMLSQS

SEQ ID NO: 81 - protein, 6 aa, Artificial sequence
  an artificially synthesized sequence
PLGLWA

SEQ ID NO: 82 - protein, 13 aa, Artificial sequence
  an artificially synthesized sequence
GAGRPFSMIMGAG

SEQ ID NO: 83 - protein, 13 aa, Artificial sequence
  an artificially synthesized sequence
GAGVPLSLTMGAG

SEQ ID NO: 84 - protein, 13 aa, Artificial sequence
  an artificially synthesized sequence
GAGVPLSLYSGAG

SEQ ID NO: 85 - protein, 6 aa, Artificial sequence
  an artificially synthesized sequence
AANLRN

SEQ ID NO: 86 - protein, 6 aa, Artificial sequence
  an artificially synthesized sequence
AQAYVK

SEQ ID NO: 87 - protein, 6 aa, Artificial sequence
  an artificially synthesized sequence
AANYMR

SEQ ID NO: 88 - protein, 6 aa, Artificial sequence
  an artificially synthesized sequence
AAALTR

SEQ ID NO: 89 - protein, 6 aa, Artificial sequence
  an artificially synthesized sequence
AQNLMR

SEQ ID NO: 90 - protein, 6 aa, Artificial sequence
  an artificially synthesized sequence
AANYTK

SEQ ID NO: 91 - protein, 16 aa, Artificial sequence
  an artificially synthesized sequence
GAGPQGLAGQRGIVAG

SEQ ID NO: 92 - protein, 8 aa, Artificial sequence
  an artificially synthesized sequence
PRFKIIGG

SEQ ID NO: 93 - protein, 8 aa, Artificial sequence
  an artificially synthesized sequence
PRFRIIGG

SEQ ID NO: 94 - protein, 9 aa, Artificial sequence
  an artificially synthesized sequence
GAGSGRSAG

SEQ ID NO: 95 - protein, 5 aa, Artificial sequence
  an artificially synthesized sequence
SGRSA

SEQ ID NO: 96 - protein, 6 aa, Artificial sequence
  an artificially synthesized sequence
GSGRSA

SEQ ID NO: 97 - protein, 5 aa, Artificial sequence
  an artificially synthesized sequence
SGKSA

SEQ ID NO: 98 - protein, 5 aa, Artificial sequence
  an artificially synthesized sequence
SGRSS

SEQ ID NO: 99 - protein, 5 aa, Artificial sequence
  an artificially synthesized sequence
SGRRA

SEQ ID NO: 100 - protein, 5 aa, Artificial sequence
  an artificially synthesized sequence
SGRNA

SEQ ID NO: 101 - protein, 5 aa, Artificial sequence
  an artificially synthesized sequence
SGRKA

SEQ ID NO: 102 - protein, 6 aa, Artificial sequence
  an artificially synthesized sequence
QRGRSA

SEQ ID NO: 103 - protein, 17 aa, Artificial sequence
  an artificially synthesized sequence
GAGSLLKSRMVPNFNAG

SEQ ID NO: 104 - protein, 6 aa, Artificial sequence
  an artificially synthesized sequence
TQGAAA

SEQ ID NO: 105 - protein, 6 aa, Artificial sequence
  an artificially synthesized sequence
GAAAAA

SEQ ID NO: 106 - protein, 6 aa, Artificial sequence
  an artificially synthesized sequence
GAGAAG

SEQ ID NO: 107 - protein, 6 aa, Artificial sequence
  an artificially synthesized sequence
AAAAAG

SEQ ID NO: 108 - protein, 6 aa, Artificial sequence
  an artificially synthesized sequence
LCGAAI

SEQ ID NO: 109 - protein, 6 aa, Artificial sequence
  an artificially synthesized sequence
FAQALG

SEQ ID NO: 110 - protein, 6 aa, Artificial sequence
  an artificially synthesized sequence
LLQANP

SEQ ID NO: 111 - protein, 6 aa, Artificial sequence
  an artificially synthesized sequence
LAAANP

SEQ ID NO: 112 - protein, 6 aa, Artificial sequence
  an artificially synthesized sequence
LYGAQF

SEQ ID NO: 113 - protein, 6 aa, Artificial sequence
  an artificially synthesized sequence
LSQAQG

SEQ ID NO: 114 - protein, 6 aa, Artificial sequence
  an artificially synthesized sequence
ASAASG

SEQ ID NO: 115 - protein, 6 aa, Artificial sequence
  an artificially synthesized sequence
FLGASL

SEQ ID NO: 116 - protein, 6 aa, Artificial sequence
  an artificially synthesized sequence
AYGATG

SEQ ID NO: 117 - protein, 6 aa, Artificial sequence
  an artificially synthesized sequence
LAQATG

SEQ ID NO: 118 - protein, 17 aa, Artificial sequence
  an artificially synthesized sequence
GAGSGVVIATVIVITAG

SEQ ID NO: 119 - protein, 8 aa, Artificial sequence
  an artificially synthesized sequence
APMAEGGG

SEQ ID NO: 120 - protein, 8 aa, Artificial sequence
  an artificially synthesized sequence
EAQGDKII

SEQ ID NO: 121 - protein, 8 aa, Artificial sequence
  an artificially synthesized sequence
LAFSDAGP

SEQ ID NO: 122 - protein, 7 aa, Artificial sequence
  an artificially synthesized sequence
YVADAPK

SEQ ID NO: 123 - protein, 5 aa, Artificial sequence
  an artificially synthesized sequence
RRRRR

SEQ ID NO: 124 - protein, 6 aa, Artificial sequence
  an artificially synthesized sequence
RRRRRR

SEQ ID NO: 125 - protein, 10 aa, Artificial sequence
  an artificially synthesized sequence
GQSSRHRRAL

SEQ ID NO: 126 - protein, 9 aa, Artificial sequence
  an artificially synthesized sequence
SSRHRRALD

SEQ ID NO: 127 - protein, 14 aa, Artificial sequence
  an artificially synthesized sequence
RKSSIIIRMRDVVL

SEQ ID NO: 128 - protein, 15 aa, Artificial sequence
  an artificially synthesized sequence
SSSFDKGKYKKGDDA

SEQ ID NO: 129 - protein, 15 aa, Artificial sequence
  an artificially synthesized sequence
SSSFDKGKYKRGDDA

SEQ ID NO: 130 - protein, 4 aa, Artificial sequence
  an artificially synthesized sequence
IEGR

SEQ ID NO: 131 - protein, 4 aa, Artificial sequence
  an artificially synthesized sequence
IDGR

SEQ ID NO: 132 - protein, 7 aa, Artificial sequence
  an artificially synthesized sequence
GGSIDGR

SEQ ID NO: 133 - protein, 8 aa, Artificial sequence
  an artificially synthesized sequence
GPQGIAGQ

SEQ ID NO: 134 - protein, 8 aa, Artificial sequence
  an artificially synthesized sequence
GPQGLLGA

SEQ ID NO: 135 - protein, 5 aa, Artificial sequence
  an artificially synthesized sequence
GIAGQ

SEQ ID NO: 136 - protein, 7 aa, Artificial sequence
  an artificially synthesized sequence
GPLGIAG

SEQ ID NO: 137 - protein, 8 aa, Artificial sequence
  an artificially synthesized sequence
GPEGLRVG

SEQ ID NO: 138 - protein, 8 aa, Artificial sequence
  an artificially synthesized sequence
YGAGLGVV

SEQ ID NO: 139 - protein, 8 aa, Artificial sequence
  an artificially synthesized sequence
AGLGVVER

SEQ ID NO: 140 - protein, 8 aa, Artificial sequence
  an artificially synthesized sequence
AGLGISST

SEQ ID NO: 141 - protein, 8 aa, Artificial sequence
  an artificially synthesized sequence
EPQALAMS

SEQ ID NO: 142 - protein, 8 aa, Artificial sequence
  an artificially synthesized sequence
QALAMSAI

SEQ ID NO: 143 - protein, 8 aa, Artificial sequence
  an artificially synthesized sequence
AAYHLVSQ

SEQ ID NO: 144 - protein, 8 aa, Artificial sequence
  an artificially synthesized sequence
MDAFLESS

SEQ ID NO: 145 - protein, 8 aa, Artificial sequence
  an artificially synthesized sequence
ESLPVVAV

SEQ ID NO: 146 - protein, 8 aa, Artificial sequence
  an artificially synthesized sequence
SAPAVESE

SEQ ID NO: 147 - protein, 8 aa, Artificial sequence
  an artificially synthesized sequence
DVAQFVLT

SEQ ID NO: 148 - protein, 8 aa, Artificial sequence
  an artificially synthesized sequence
VAQFVLTE

SEQ ID NO: 149 - protein, 8 aa, Artificial sequence
  an artificially synthesized sequence
AQFVLTEG

SEQ ID NO: 150 - protein, 8 aa, Artificial sequence
  an artificially synthesized sequence
PVQPIGPQ

SEQ ID NO: 151 - protein, 6 aa, Artificial sequence
  an artificially synthesized sequence
LVPRGS

SEQ ID NO: 152 - protein, 214 aa, Artificial sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEA

SEQ ID NO: 153 - protein, 107 aa, Artificial sequence
  an artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEA

SEQ ID NO: 154 - protein, 464 aa, Artificial sequence
  an artificially synthesized sequence
QLQLVESGGGLVQPGGSLRLSCTASGISFSISTMGWYRQAPGKQRELVATITSGGEAYYANSMKDRFTISRDNAENTVYLQMNRLKPEDSAVYYCNTKFPWSTDWDSRGQGTQVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 155 - protein, 464 aa, Artificial sequence
  an artificially synthesized sequence
QVQLVESGGGLVQPGGSLRLSCTASGISFSISTMGWYRQAPGKQRELVATITSGGEAYYANSMKDRFTISRDNAENTVYLQMNRLKPEDSAVYYCNTKFPWSTDWDSRGQGTQVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 156 - protein, 464 aa, Artificial sequence
  an artificially synthesized sequence
QVQLVESGGGLVQPGGSLRLSCTASGISFSISTMGWYRQAPGKQRELVATITSGGEAYYANSMKDRFTISRDNAENTVYLQMNRLKPEDSAVYYCNTKFPWSTDWNARGQGTQVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 157 - protein, 464 aa, Artificial sequence
  an artificially synthesized sequence
QLQLVESGGGLVQPGGSLRLSCTASGISFSISTMGWYRQAPGKQRELVATIASGGEAYYANSVKGRFTISRDNAENTVYLQMNRLKPEDSAVYYCNTKFPWSTDWNARGQGTQVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 158 - protein, 464 aa, Artificial sequence
  an artificially synthesized sequence
QLQLVESGGGLVQPGGSLRLSCTASGISFSISTMGWYRQAPGKQRELVATIASGGEAYYANSVKGRFTISREYAENTVFLQMNRLKPEDSAVYYCNTKFPWSTDWNARGQGTQVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 159 - protein, 116 aa, Artificial sequence
  an artificially synthesized sequence
QVQLVQSGGGLVQPGGSLRLSCAASYFDFDSYEMSWVRQAPGKGLEWIGSIYHSGSTYYNPSLKSRVTISRDNSKNTLYLQMNTLRAEDTATYYCARVNMDRFDYWGQGTLVTVSS

SEQ ID NO: 160 - protein, 124 aa, Artificial sequence
  an artificially synthesized sequence
EVQLVESGGGPVQAGGSLRLSCAASGRTYRGYSMGWFRQAPGKEREFVAAIVWSGGNTYYEDSVKGRFTISRDNAKNTMYLQMTSLKPEDSATYYCAAKIRPYIFKIAGQYDYWGQGTLVTVSS

SEQ ID NO: 161 - protein, 354 aa, Artificial sequence
  an artificially synthesized sequence
GSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 162 - protein, 629 aa, Artificial sequence
  an artificially synthesized sequence
QVQLVQSGGGLVQPGGSLRLSCAASYFDFDSYEMSWVRQAPGKGLEWIGSIYHSGSTYYNPSLKSRVTISRDNSKNTLYLQMNTLRAEDTATYYCARVNMDRFDYWGQGTLVTVSSGGGGSGGGGSGGGGSGGGGSGGGGSGGGGSGGGGSEVQLVESGGGPVQAGGSLRLSCAASGRTYRGYSMGWFRQAPGKEREFVAAIVWSGGNTYYEDSVKGRFTISRDNAKNTMYLQMTSLKPEDSATYYCAAKIRPYIFKIAGQYDYWGQGTLVTVSSGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 163 - protein, 118 aa, Artificial sequence
  an artificially synthesized sequence
EVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTLVTVSS

SEQ ID NO: 164 - protein, 631 aa, Artificial sequence
  an artificially synthesized sequence
EVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTLVTVSSGGGGSGGGGSGGGGSGGGGSGGGGSGGGGSGGGGSEVQLVESGGGPVQAGGSLRLSCAASGRTYRGYSMGWFRQAPGKEREFVAAIVWSGGNTYYEDSVKGRFTISRDNAKNTMYLQMTSLKPEDSATYYCAAKIRPYIFKIAGQYDYWGQGTLVTVSSGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 165 - protein, 468 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAGAGIPVSLRSGAGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 166 - protein, 230 aa, Artificial sequence
  an artificially synthesized sequence
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 167 - protein, 455 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 168 - protein, 12 aa, Artificial sequence
  an artificially synthesized sequence
TSGSGRSANARG

SEQ ID NO: 169 - protein, 12 aa, Artificial sequence
  an artificially synthesized sequence
TSQSGRSANQRG

SEQ ID NO: 170 - protein, 12 aa, Artificial sequence
  an artificially synthesized sequence
TSPSGRSAYPRG

SEQ ID NO: 171 - protein, 12 aa, Artificial sequence
  an artificially synthesized sequence
TSGSGRSATPRG

SEQ ID NO: 172 - protein, 12 aa, Artificial sequence
  an artificially synthesized sequence
TSQSGRSATPRG

SEQ ID NO: 173 - protein, 12 aa, Artificial sequence
  an artificially synthesized sequence
TSASGRSATPRG

SEQ ID NO: 174 - protein, 12 aa, Artificial sequence
  an artificially synthesized sequence
TSYSGRSAVPRG

SEQ ID NO: 175 - protein, 12 aa, Artificial sequence
  an artificially synthesized sequence
TSYSGRSANFRG

SEQ ID NO: 176 - protein, 12 aa, Artificial sequence
  an artificially synthesized sequence
TSSSGRSATPRG

SEQ ID NO: 177 - protein, 12 aa, Artificial sequence
  an artificially synthesized sequence
TSTTGRSASPRG

SEQ ID NO: 178 - protein, 12 aa, Artificial sequence
  an artificially synthesized sequence
TSTSGRSANPRG

SEQ ID NO: 179 - protein, 467 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSTSGSGRSANARGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 180 - protein, 467 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSTSQSGRSANQRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 181 - protein, 467 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSTSPSGRSAYPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 182 - protein, 467 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSTSGSGRSATPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 183 - protein, 467 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSTSQSGRSATPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 184 - protein, 467 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSTSASGRSATPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 185 - protein, 467 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSTSYSGRSAVPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 186 - protein, 467 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSTSYSGRSANFRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 187 - protein, 467 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSTSSSGRSATPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 188 - protein, 467 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSTSTTGRSASPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 189 - protein, 467 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSTSTSGRSANPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 190 - protein, 127 aa, Artificial sequence
  an artificially synthesized sequence
EVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSS

SEQ ID NO: 191 - protein, 455 aa, Artificial sequence
  an artificially synthesized sequence
EVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 192 - protein, 455 aa, Artificial sequence
  an artificially synthesized sequence
EVQLVESGGGLVQPGGSLRLSCAASGFTFSDYDIGWVRQAPGKGLEWVSGISSSDGNTYYADSVKGRFTISRDNAKNTLYLQMNSLRPEDTAVYYCAAEPPDSSWYLDGSPEFFKYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 193 - protein, 16 aa, Artificial sequence
  an artificially synthesized sequence
GGGGSPLGLAGGGGGS

SEQ ID NO: 194 - protein, 18 aa, Artificial sequence
  an artificially synthesized sequence
GGGGSGPLGIAGQGGGGS

SEQ ID NO: 195 - protein, 23 aa, Artificial sequence
  an artificially synthesized sequence
GGGGSGAGVPLSLYSGAGGGGGS

SEQ ID NO: 196 - protein, 471 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAGGGGSPLGLAGGGGGSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 197 - protein, 473 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAGGGGSGPLGIAGQGGGGSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 198 - protein, 478 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAGGGGSGAGVPLSLYSGAGGGGGSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 199 - protein, 8 aa, Artificial sequence
  an artificially synthesized sequence
DYKDDDDK

SEQ ID NO: 200 - protein, 1267 aa, Artificial sequence
  an artificially synthesized sequence
MWWRLWWLLLLLLLLWPMVWAEAGLPRAGGGSQPPFRTFSASDWGLTHLVVHEQTGEVYVGAVNRIYKLSGNLTLLRAHVTGPVEDNEKCYPPPSVQSCPHGLGSTDNVNKLLLLDYAANRLLACGSASQGICQFLRLDDLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFCGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSICSRRDACERADEPQRFAADLLQCVQLTVQPRNVSVTMSQVPLVLQAWNVPDLSAGVNCSFEDFTESESVLEDGRIHCRSPSAREVAPITRGQGDQRVVKLYLKSKETGKKFASVDFVFYNCSVHQSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRESCGLCLKADPRFECGWCVAERRCSLRHHCAADTPASWMHARHGSSRCTDPKILKLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWRNSREIRCLTPPGQSPGSAPIIININRAQLTNPEVKYNYTEDPTILRIDPEWSINSGGTLLTVTGTNLATVREPRIRAKYGGIERENGCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRAGGFEFSPGTLQVYSDSLLTLPDYKDDDDKGGGGSGLNDIFEAQKIEWHE

SEQ ID NO: 201 - protein, 347 aa, Artificial sequence
  an artificially synthesized sequence
MVLASSTTSIHTMLLLLLMLAQPAMAMKDNTVPLKLIALLANGEFHSGEQLGETLGMSRAAINKHIQTLRDWGVDVFTVPGKGYSLPEPIQLLNAKQILGQLDGGSVAVLPVIDSTNQYLLDRIGELKSGDACIAEYQQAGRGRRGRKWFSPFGANLYLSMFWRLEQGPAAAIGLSLVIGIVMAEVLRKLGADKVRVKWPNDLYLQDRKLAGILVELTGKTGDAAQIVIGAGINMAMRRVEESVVNQGWITLQEAGINLDRNTLAAMLIRELRAALELFEQEGLAPYLSRWEKLDNFINRPVKLIIGDKEIFGISRGIDKQGALLLEQDGIIKPWMGGEISLRSAEK

SEQ ID NO: 202 - protein, 463 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAGPLGIAGQSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 203 - protein, 465 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAGGPLGMLSQSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 204 - protein, 461 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAPLGLWASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 205 - protein, 463 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAVPLSLTMGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 206 - protein, 468 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAGAGVPLSLTMGAGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 207 - protein, 471 aa, Artificial sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAGAGPQGLAGQRGIVAGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 208 - protein, 12 aa, Artificial sequence
  an artificially synthesized sequence
TSASGRSANPRG

SEQ ID NO: 209 - protein, 12 aa, Artificial sequence
  an artificially synthesized sequence
TSESGRSANPRG

SEQ ID NO: 210 - protein, 12 aa, Artificial sequence
  an artificially synthesized sequence
TSFSGRSANPRG

SEQ ID NO: 211 - protein, 12 aa, Artificial sequence
  an artificially synthesized sequence
TSGSGRSANPRG

SEQ ID NO: 212 - protein, 12 aa, Artificial sequence
  an artificially synthesized sequence
TSHSGRSANPRG

SEQ ID NO: 213 - protein, 12 aa, Artificial sequence
  an artificially synthesized sequence
TSKSGRSANPRG

SEQ ID NO: 214 - protein, 12 aa, Artificial sequence
  an artificially synthesized sequence
TSMSGRSANPRG

SEQ ID NO: 215 - protein, 12 aa, Artificial sequence
  an artificially synthesized sequence
TSNSGRSANPRG

SEQ ID NO: 216 - protein, 12 aa, Artificial sequence
  an artificially synthesized sequence
TSPSGRSANPRG

SEQ ID NO: 217 - protein, 12 aa, Artificial sequence
  an artificially synthesized sequence
TSQSGRSANPRG

SEQ ID NO: 218 - protein, 12 aa, Artificial sequence
  an artificially synthesized sequence
TSWSGRSANPRG

SEQ ID NO: 219 - protein, 12 aa, Artificial sequence
  an artificially synthesized sequence
TSYSGRSANPRG

SEQ ID NO: 220 - protein, 12 aa, Artificial sequence
  an artificially synthesized sequence
TSTAGRSANPRG

SEQ ID NO: 221 - protein, 12 aa, Artificial sequence
  an artificially synthesized sequence
TSTDGRSANPRG

SEQ ID NO: 222 - protein, 12 aa, Artificial sequence
  an artificially synthesized sequence
TSTEGRSANPRG

SEQ ID NO: 223 - protein, 12 aa, Artificial sequence
  an artificially synthesized sequence
TSTFGRSANPRG

SEQ ID NO: 224 - protein, 12 aa, Artificial sequence
  an artificially synthesized sequence
TSTLGRSANPRG

SEQ ID NO: 225 - protein, 12 aa, Artificial sequence
  an artificially synthesized sequence
TSTMGRSANPRG

SEQ ID NO: 226 - protein, 12 aa, Artificial sequence
  an artificially synthesized sequence
TSTPGRSANPRG

SEQ ID NO: 227 - protein, 12 aa, Artificial sequence
  an artificially synthesized sequence
TSTQGRSANPRG

SEQ ID NO: 228 - protein, 12 aa, Artificial sequence
  an artificially synthesized sequence
TSTVGRSANPRG

SEQ ID NO: 229 - protein, 12 aa, Artificial sequence
  an artificially synthesized sequence
TSTWGRSANPRG

SEQ ID NO: 230 - protein, 12 aa, Artificial sequence
  an artificially synthesized sequence
TSTSARSANPRG

SEQ ID NO: 231 - protein, 12 aa, Artificial sequence
  an artificially synthesized sequence
TSTSERSANPRG

SEQ ID NO: 232 - protein, 12 aa, Artificial sequence
  an artificially synthesized sequence
TSTSFRSANPRG

SEQ ID NO: 233 - protein, 12 aa, Artificial sequence
  an artificially synthesized sequence
TSTSHRSANPRG

SEQ ID NO: 234 - protein, 12 aa, Artificial sequence
  an artificially synthesized sequence
TSTSIRSANPRG

SEQ ID NO: 235 - protein, 12 aa, Artificial sequence
  an artificially synthesized sequence
TSTSKRSANPRG

SEQ ID NO: 236 - protein, 12 aa, Artificial sequence
  an artificially synthesized sequence
TSTSLRSANPRG

SEQ ID NO: 237 - protein, 12 aa, Artificial sequence
  an artificially synthesized sequence
TSTSMRSANPRG

SEQ ID NO: 238 - protein, 12 aa, Artificial sequence
  an artificially synthesized sequence
TSTSNRSANPRG

SEQ ID NO: 239 - protein, 12 aa, Artificial sequence
  an artificially synthesized sequence
TSTSPRSANPRG

SEQ ID NO: 240 - protein, 12 aa, Artificial sequence
  an artificially synthesized sequence
TSTSQRSANPRG

SEQ ID NO: 241 - protein, 12 aa, Artificial sequence
  an artificially synthesized sequence
TSTSRRSANPRG

SEQ ID NO: 242 - protein, 12 aa, Artificial sequence
  an artificially synthesized sequence
TSTSTRSANPRG

SEQ ID NO: 243 - protein, 12 aa, Artificial sequence
  an artificially synthesized sequence
TSTSVRSANPRG

SEQ ID NO: 244 - protein, 12 aa, Artificial sequence
  an artificially synthesized sequence
TSTSWRSANPRG

SEQ ID NO: 245 - protein, 12 aa, Artificial sequence
  an artificially synthesized sequence
TSTSYRSANPRG

SEQ ID NO: 246 - protein, 12 aa, Artificial sequence
  an artificially synthesized sequence
TSTSGRAANPRG

SEQ ID NO: 247 - protein, 12 aa, Artificial sequence
  an artificially synthesized sequence
TSTSGRDANPRG

SEQ ID NO: 248 - protein, 12 aa, Artificial sequence
  an artificially synthesized sequence
TSTSGREANPRG

SEQ ID NO: 249 - protein, 12 aa, Artificial sequence
  an artificially synthesized sequence
TSTSGRGANPRG

SEQ ID NO: 250 - protein, 12 aa, Artificial sequence
  an artificially synthesized sequence
TSTSGRHANPRG

SEQ ID NO: 251 - protein, 12 aa, Artificial sequence
  an artificially synthesized sequence
TSTSGRIANPRG

SEQ ID NO: 252 - protein, 12 aa, Artificial sequence
  an artificially synthesized sequence
TSTSGRKANPRG

SEQ ID NO: 253 - protein, 12 aa, Artificial sequence
  an artificially synthesized sequence
TSTSGRLANPRG

SEQ ID NO: 254 - protein, 12 aa, Artificial sequence
  an artificially synthesized sequence
TSTSGRMANPRG

SEQ ID NO: 255 - protein, 12 aa, Artificial sequence
  an artificially synthesized sequence
TSTSGRNANPRG

SEQ ID NO: 256 - protein, 12 aa, Artificial sequence
  an artificially synthesized sequence
TSTSGRPANPRG

SEQ ID NO: 257 - protein, 12 aa, Artificial sequence
  an artificially synthesized sequence
TSTSGRQANPRG

SEQ ID NO: 258 - protein, 12 aa, Artificial sequence
  an artificially synthesized sequence
TSTSGRRANPRG

SEQ ID NO: 259 - protein, 12 aa, Artificial sequence
  an artificially synthesized sequence
TSTSGRTANPRG

SEQ ID NO: 260 - protein, 12 aa, Artificial sequence
  an artificially synthesized sequence
TSTSGRVANPRG

SEQ ID NO: 261 - protein, 12 aa, Artificial sequence
  an artificially synthesized sequence
TSTSGRWANPRG

SEQ ID NO: 262 - protein, 12 aa, Artificial sequence
  an artificially synthesized sequence
TSTSGRYANPRG

SEQ ID NO: 263 - protein, 12 aa, Artificial sequence
  an artificially synthesized sequence
TSTSGRSENPRG

SEQ ID NO: 264 - protein, 12 aa, Artificial sequence
  an artificially synthesized sequence
TSTSGRSFNPRG

SEQ ID NO: 265 - protein, 12 aa, Artificial sequence
  an artificially synthesized sequence
TSTSGRSKNPRG

SEQ ID NO: 266 - protein, 12 aa, Artificial sequence
  an artificially synthesized sequence
TSTSGRSMNPRG

SEQ ID NO: 267 - protein, 12 aa, Artificial sequence
  an artificially synthesized sequence
TSTSGRSNNPRG

SEQ ID NO: 268 - protein, 12 aa, Artificial sequence
  an artificially synthesized sequence
TSTSGRSPNPRG

SEQ ID NO: 269 - protein, 12 aa, Artificial sequence
  an artificially synthesized sequence
TSTSGRSQNPRG

SEQ ID NO: 270 - protein, 12 aa, Artificial sequence
  an artificially synthesized sequence
TSTSGRSRNPRG

SEQ ID NO: 271 - protein, 12 aa, Artificial sequence
  an artificially synthesized sequence
TSTSGRSSNPRG

SEQ ID NO: 272 - protein, 12 aa, Artificial sequence
  an artificially synthesized sequence
TSTSGRSWNPRG

SEQ ID NO: 273 - protein, 12 aa, Artificial sequence
  an artificially synthesized sequence
TSTSGRSYNPRG

SEQ ID NO: 274 - protein, 12 aa, Artificial sequence
  an artificially synthesized sequence
TSTSGRSAAPRG

SEQ ID NO: 275 - protein, 12 aa, Artificial sequence
  an artificially synthesized sequence
TSTSGRSADPRG

SEQ ID NO: 276 - protein, 12 aa, Artificial sequence
  an artificially synthesized sequence
TSTSGRSAEPRG

SEQ ID NO: 277 - protein, 12 aa, Artificial sequence
  an artificially synthesized sequence
TSTSGRSAFPRG

SEQ ID NO: 278 - protein, 12 aa, Artificial sequence
  an artificially synthesized sequence
TSTSGRSAGPRG

SEQ ID NO: 279 - protein, 12 aa, Artificial sequence
  an artificially synthesized sequence
TSTSGRSAKPRG

SEQ ID NO: 280 - protein, 12 aa, Artificial sequence
  an artificially synthesized sequence
TSTSGRSALPRG

SEQ ID NO: 281 - protein, 12 aa, Artificial sequence
  an artificially synthesized sequence
TSTSGRSAMPRG

SEQ ID NO: 282 - protein, 12 aa, Artificial sequence
  an artificially synthesized sequence
TSTSGRSAPPRG

SEQ ID NO: 283 - protein, 12 aa, Artificial sequence
  an artificially synthesized sequence
TSTSGRSAQPRG

SEQ ID NO: 284 - protein, 12 aa, Artificial sequence
  an artificially synthesized sequence
TSTSGRSAVPRG

SEQ ID NO: 285 - protein, 12 aa, Artificial sequence
  an artificially synthesized sequence
TSTSGRSAWPRG

SEQ ID NO: 286 - protein, 12 aa, Artificial sequence
  an artificially synthesized sequence
TSTSGRSAYPRG

SEQ ID NO: 287 - protein, 12 aa, Artificial sequence
  an artificially synthesized sequence
TSTSGRSANARG

SEQ ID NO: 288 - protein, 12 aa, Artificial sequence
  an artificially synthesized sequence
TSTSGRSANDRG

SEQ ID NO: 289 - protein, 12 aa, Artificial sequence
  an artificially synthesized sequence
TSTSGRSANERG

SEQ ID NO: 290 - protein, 12 aa, Artificial sequence
  an artificially synthesized sequence
TSTSGRSANFRG

SEQ ID NO: 291 - protein, 12 aa, Artificial sequence
  an artificially synthesized sequence
TSTSGRSANGRG

SEQ ID NO: 292 - protein, 12 aa, Artificial sequence
  an artificially synthesized sequence
TSTSGRSANIRG

SEQ ID NO: 293 - protein, 12 aa, Artificial sequence
  an artificially synthesized sequence
TSTSGRSANKRG

SEQ ID NO: 294 - protein, 12 aa, Artificial sequence
  an artificially synthesized sequence
TSTSGRSANNRG

SEQ ID NO: 295 - protein, 12 aa, Artificial sequence
  an artificially synthesized sequence
TSTSGRSANQRG

SEQ ID NO: 296 - protein, 12 aa, Artificial sequence
  an artificially synthesized sequence
TSTSGRSANSRG

SEQ ID NO: 297 - protein, 12 aa, Artificial sequence
  an artificially synthesized sequence
TSTSGRSANTRG

SEQ ID NO: 298 - protein, 12 aa, Artificial sequence
  an artificially synthesized sequence
TSTSGRSANWRG

SEQ ID NO: 299 - protein, 12 aa, Artificial sequence
  an artificially synthesized sequence
TSDSGRSANPRG

SEQ ID NO: 300 - protein, 12 aa, Artificial sequence
  an artificially synthesized sequence
TSISGRSANPRG

SEQ ID NO: 301 - protein, 12 aa, Artificial sequence
  an artificially synthesized sequence
TSSSGRSANPRG

SEQ ID NO: 302 - protein, 12 aa, Artificial sequence
  an artificially synthesized sequence
TSTHGRSANPRG

SEQ ID NO: 303 - protein, 12 aa, Artificial sequence
  an artificially synthesized sequence
TSTKGRSANPRG

SEQ ID NO: 304 - protein, 12 aa, Artificial sequence
  an artificially synthesized sequence
TSTTGRSANPRG

SEQ ID NO: 305 - protein, 12 aa, Artificial sequence
  an artificially synthesized sequence
TSTYGRSANPRG

SEQ ID NO: 306 - protein, 12 aa, Artificial sequence
  an artificially synthesized sequence
TSTSDRSANPRG

SEQ ID NO: 307 - protein, 12 aa, Artificial sequence
  an artificially synthesized sequence
TSTSSRSANPRG

SEQ ID NO: 308 - protein, 12 aa, Artificial sequence
  an artificially synthesized sequence
TSTSGRFANPRG

SEQ ID NO: 309 - protein, 12 aa, Artificial sequence
  an artificially synthesized sequence
TSTSGRSDNPRG

SEQ ID NO: 310 - protein, 12 aa, Artificial sequence
  an artificially synthesized sequence
TSTSGRSHNPRG

SEQ ID NO: 311 - protein, 12 aa, Artificial sequence
  an artificially synthesized sequence
TSTSGRSINPRG

SEQ ID NO: 312 - protein, 12 aa, Artificial sequence
  an artificially synthesized sequence
TSTSGRSLNPRG

SEQ ID NO: 313 - protein, 12 aa, Artificial sequence
  an artificially synthesized sequence
TSTSGRSTNPRG

SEQ ID NO: 314 - protein, 12 aa, Artificial sequence
  an artificially synthesized sequence
TSTSGRSVNPRG

SEQ ID NO: 315 - protein, 12 aa, Artificial sequence
  an artificially synthesized sequence
TSTSGRSAHPRG

SEQ ID NO: 316 - protein, 12 aa, Artificial sequence
  an artificially synthesized sequence
TSTSGRSAIPRG

SEQ ID NO: 317 - protein, 12 aa, Artificial sequence
  an artificially synthesized sequence
TSTSGRSARPRG

SEQ ID NO: 318 - protein, 12 aa, Artificial sequence
  an artificially synthesized sequence
TSTSGRSASPRG

SEQ ID NO: 319 - protein, 12 aa, Artificial sequence
  an artificially synthesized sequence
TSTSGRSATPRG

SEQ ID NO: 320 - protein, 12 aa, Artificial sequence
  an artificially synthesized sequence
TSTSGRSANHRG

SEQ ID NO: 321 - protein, 12 aa, Artificial sequence
  an artificially synthesized sequence
TSTSGRSANLRG

SEQ ID NO: 322 - protein, 12 aa, Artificial sequence
  an artificially synthesized sequence
TSTSGRSANMRG

SEQ ID NO: 323 - protein, 12 aa, Artificial sequence
  an artificially synthesized sequence
TSTSGRSANRRG

SEQ ID NO: 324 - protein, 12 aa, Artificial sequence
  an artificially synthesized sequence
TSTSGRSANVRG

SEQ ID NO: 325 - protein, 12 aa, Artificial sequence
  an artificially synthesized sequence
TSTSGRSANYRG

SEQ ID NO: 326 - protein, 12 aa, Artificial sequence
  an artificially synthesized sequence
TSGSGRSAVPRG

SEQ ID NO: 327 - protein, 12 aa, Artificial sequence
  an artificially synthesized sequence
TSGSGRSAYPRG

SEQ ID NO: 328 - protein, 12 aa, Artificial sequence
  an artificially synthesized sequence
TSGSGRSANQRG

SEQ ID NO: 329 - protein, 12 aa, Artificial sequence
  an artificially synthesized sequence
TSGSGRSANIRG

SEQ ID NO: 330 - protein, 12 aa, Artificial sequence
  an artificially synthesized sequence
TSGSGRSANFRG

SEQ ID NO: 331 - protein, 12 aa, Artificial sequence
  an artificially synthesized sequence
TSGSGRSANSRG

SEQ ID NO: 332 - protein, 12 aa, Artificial sequence
  an artificially synthesized sequence
TSQSGRSAVPRG

SEQ ID NO: 333 - protein, 12 aa, Artificial sequence
  an artificially synthesized sequence
TSQSGRSAYPRG

SEQ ID NO: 334 - protein, 12 aa, Artificial sequence
  an artificially synthesized sequence
TSQSGRSANARG

SEQ ID NO: 335 - protein, 12 aa, Artificial sequence
  an artificially synthesized sequence
TSQSGRSANIRG

SEQ ID NO: 336 - protein, 12 aa, Artificial sequence
  an artificially synthesized sequence
TSQSGRSANFRG

SEQ ID NO: 337 - protein, 12 aa, Artificial sequence
  an artificially synthesized sequence
TSQSGRSANSRG

SEQ ID NO: 338 - protein, 12 aa, Artificial sequence
  an artificially synthesized sequence
TSPSGRSAVPRG

SEQ ID NO: 339 - protein, 12 aa, Artificial sequence
  an artificially synthesized sequence
TSPSGRSANQRG

SEQ ID NO: 340 - protein, 12 aa, Artificial sequence
  an artificially synthesized sequence
TSPSGRSANARG

SEQ ID NO: 341 - protein, 12 aa, Artificial sequence
  an artificially synthesized sequence
TSPSGRSANIRG

SEQ ID NO: 342 - protein, 12 aa, Artificial sequence
  an artificially synthesized sequence
TSPSGRSANFRG

SEQ ID NO: 343 - protein, 12 aa, Artificial sequence
  an artificially synthesized sequence
TSPSGRSANSRG

SEQ ID NO: 344 - protein, 12 aa, Artificial sequence
  an artificially synthesized sequence
TSASGRSAVPRG

SEQ ID NO: 345 - protein, 12 aa, Artificial sequence
  an artificially synthesized sequence
TSASGRSAYPRG

SEQ ID NO: 346 - protein, 12 aa, Artificial sequence
  an artificially synthesized sequence
TSASGRSANQRG

SEQ ID NO: 347 - protein, 12 aa, Artificial sequence
  an artificially synthesized sequence
TSASGRSANARG

SEQ ID NO: 348 - protein, 12 aa, Artificial sequence
  an artificially synthesized sequence
TSASGRSANIRG

SEQ ID NO: 349 - protein, 12 aa, Artificial sequence
  an artificially synthesized sequence
TSASGRSANFRG

SEQ ID NO: 350 - protein, 12 aa, Artificial sequence
  an artificially synthesized sequence
TSASGRSANSRG

SEQ ID NO: 351 - protein, 12 aa, Artificial sequence
  an artificially synthesized sequence
TSYSGRSENPRG

SEQ ID NO: 352 - protein, 12 aa, Artificial sequence
  an artificially synthesized sequence
TSGSGRSENPRG

SEQ ID NO: 353 - protein, 12 aa, Artificial sequence
  an artificially synthesized sequence
TSQSGRSENPRG

SEQ ID NO: 354 - protein, 12 aa, Artificial sequence
  an artificially synthesized sequence
TSPSGRSENPRG

SEQ ID NO: 355 - protein, 12 aa, Artificial sequence
  an artificially synthesized sequence
TSASGRSENPRG

SEQ ID NO: 356 - protein, 12 aa, Artificial sequence
  an artificially synthesized sequence
TSHSGRSENPRG

SEQ ID NO: 357 - protein, 12 aa, Artificial sequence
  an artificially synthesized sequence
TSTSGRSENQRG

SEQ ID NO: 358 - protein, 12 aa, Artificial sequence
  an artificially synthesized sequence
TSTSGRSENARG

SEQ ID NO: 359 - protein, 12 aa, Artificial sequence
  an artificially synthesized sequence
TSTSGRSENIRG

SEQ ID NO: 360 - protein, 12 aa, Artificial sequence
  an artificially synthesized sequence
TSTSGRSENFRG

SEQ ID NO: 361 - protein, 12 aa, Artificial sequence
  an artificially synthesized sequence
TSTSGRSENSRG

SEQ ID NO: 362 - protein, 12 aa, Artificial sequence
  an artificially synthesized sequence
TSYSGRSAEPRG

SEQ ID NO: 363 - protein, 12 aa, Artificial sequence
  an artificially synthesized sequence
TSGSGRSAEPRG

SEQ ID NO: 364 - protein, 12 aa, Artificial sequence
  an artificially synthesized sequence
TSQSGRSAEPRG

SEQ ID NO: 365 - protein, 12 aa, Artificial sequence
  an artificially synthesized sequence
TSPSGRSAEPRG

SEQ ID NO: 366 - protein, 12 aa, Artificial sequence
  an artificially synthesized sequence
TSASGRSAEPRG

SEQ ID NO: 367 - protein, 12 aa, Artificial sequence
  an artificially synthesized sequence
TSHSGRSAEPRG

SEQ ID NO: 368 - protein, 12 aa, Artificial sequence
  an artificially synthesized sequence
TSTSGRSAEQRG

SEQ ID NO: 369 - protein, 12 aa, Artificial sequence
  an artificially synthesized sequence
TSTSGRSAEARG

SEQ ID NO: 370 - protein, 12 aa, Artificial sequence
  an artificially synthesized sequence
TSTSGRSAEIRG

SEQ ID NO: 371 - protein, 12 aa, Artificial sequence
  an artificially synthesized sequence
TSTSGRSAEFRG

SEQ ID NO: 372 - protein, 12 aa, Artificial sequence
  an artificially synthesized sequence
TSTSGRSAESRG

SEQ ID NO: 373 - protein, 12 aa, Artificial sequence
  an artificially synthesized sequence
TSGTGRSANPRG

SEQ ID NO: 374 - protein, 12 aa, Artificial sequence
  an artificially synthesized sequence
TSGKGRSANPRG

SEQ ID NO: 375 - protein, 12 aa, Artificial sequence
  an artificially synthesized sequence
TSGSGRSAIPRG

SEQ ID NO: 376 - protein, 12 aa, Artificial sequence
  an artificially synthesized sequence
TSGSGRSASPRG

SEQ ID NO: 377 - protein, 12 aa, Artificial sequence
  an artificially synthesized sequence
TSGSGRSAHPRG

SEQ ID NO: 378 - protein, 12 aa, Artificial sequence
  an artificially synthesized sequence
TSGSGRSANYRG

SEQ ID NO: 379 - protein, 12 aa, Artificial sequence
  an artificially synthesized sequence
TSGSGRSANVRG

SEQ ID NO: 380 - protein, 12 aa, Artificial sequence
  an artificially synthesized sequence
TSGSGRSANHRG

SEQ ID NO: 381 - protein, 12 aa, Artificial sequence
  an artificially synthesized sequence
TSQTGRSANPRG

SEQ ID NO: 382 - protein, 12 aa, Artificial sequence
  an artificially synthesized sequence
TSQKGRSANPRG

SEQ ID NO: 383 - protein, 12 aa, Artificial sequence
  an artificially synthesized sequence
TSQSGRSAIPRG

SEQ ID NO: 384 - protein, 12 aa, Artificial sequence
  an artificially synthesized sequence
TSQSGRSASPRG

SEQ ID NO: 385 - protein, 12 aa, Artificial sequence
  an artificially synthesized sequence
TSQSGRSAHPRG

SEQ ID NO: 386 - protein, 12 aa, Artificial sequence
  an artificially synthesized sequence
TSQSGRSANYRG

SEQ ID NO: 387 - protein, 12 aa, Artificial sequence
  an artificially synthesized sequence
TSQSGRSANVRG

SEQ ID NO: 388 - protein, 12 aa, Artificial sequence
  an artificially synthesized sequence
TSQSGRSANHRG

SEQ ID NO: 389 - protein, 12 aa, Artificial sequence
  an artificially synthesized sequence
TSPTGRSANPRG

SEQ ID NO: 390 - protein, 12 aa, Artificial sequence
  an artificially synthesized sequence
TSPKGRSANPRG

SEQ ID NO: 391 - protein, 12 aa, Artificial sequence
  an artificially synthesized sequence
TSPSGRSAIPRG

SEQ ID NO: 392 - protein, 12 aa, Artificial sequence
  an artificially synthesized sequence
TSPSGRSATPRG

SEQ ID NO: 393 - protein, 12 aa, Artificial sequence
  an artificially synthesized sequence
TSPSGRSASPRG

SEQ ID NO: 394 - protein, 12 aa, Artificial sequence
  an artificially synthesized sequence
TSPSGRSAHPRG

SEQ ID NO: 395 - protein, 12 aa, Artificial sequence
  an artificially synthesized sequence
TSPSGRSANYRG

SEQ ID NO: 396 - protein, 12 aa, Artificial sequence
  an artificially synthesized sequence
TSPSGRSANVRG

SEQ ID NO: 397 - protein, 12 aa, Artificial sequence
  an artificially synthesized sequence
TSPSGRSANHRG

SEQ ID NO: 398 - protein, 12 aa, Artificial sequence
  an artificially synthesized sequence
TSATGRSANPRG

SEQ ID NO: 399 - protein, 12 aa, Artificial sequence
  an artificially synthesized sequence
TSAKGRSANPRG

SEQ ID NO: 400 - protein, 12 aa, Artificial sequence
  an artificially synthesized sequence
TSASGRSAIPRG

SEQ ID NO: 401 - protein, 12 aa, Artificial sequence
  an artificially synthesized sequence
TSASGRSASPRG

SEQ ID NO: 402 - protein, 12 aa, Artificial sequence
  an artificially synthesized sequence
TSASGRSAHPRG

SEQ ID NO: 403 - protein, 12 aa, Artificial sequence
  an artificially synthesized sequence
TSASGRSANYRG

SEQ ID NO: 404 - protein, 12 aa, Artificial sequence
  an artificially synthesized sequence
TSASGRSANVRG

SEQ ID NO: 405 - protein, 12 aa, Artificial sequence
  an artificially synthesized sequence
TSASGRSANHRG

SEQ ID NO: 406 - protein, 12 aa, Artificial sequence
  an artificially synthesized sequence
TSYTGRSANPRG

SEQ ID NO: 407 - protein, 12 aa, Artificial sequence
  an artificially synthesized sequence
TSYKGRSANPRG

SEQ ID NO: 408 - protein, 12 aa, Artificial sequence
  an artificially synthesized sequence
TSYSGRSAIPRG

SEQ ID NO: 409 - protein, 12 aa, Artificial sequence
  an artificially synthesized sequence
TSYSGRSATPRG

SEQ ID NO: 410 - protein, 12 aa, Artificial sequence
  an artificially synthesized sequence
TSYSGRSASPRG

SEQ ID NO: 411 - protein, 12 aa, Artificial sequence
  an artificially synthesized sequence
TSYSGRSAHPRG

SEQ ID NO: 412 - protein, 12 aa, Artificial sequence
  an artificially synthesized sequence
TSYSGRSANARG

SEQ ID NO: 413 - protein, 12 aa, Artificial sequence
  an artificially synthesized sequence
TSYSGRSANYRG

SEQ ID NO: 414 - protein, 12 aa, Artificial sequence
  an artificially synthesized sequence
TSYSGRSANVRG

SEQ ID NO: 415 - protein, 12 aa, Artificial sequence
  an artificially synthesized sequence
TSYSGRSANHRG

SEQ ID NO: 416 - protein, 12 aa, Artificial sequence
  an artificially synthesized sequence
TSSTGRSANPRG

SEQ ID NO: 417 - protein, 12 aa, Artificial sequence
  an artificially synthesized sequence
TSSKGRSANPRG

SEQ ID NO: 418 - protein, 12 aa, Artificial sequence
  an artificially synthesized sequence
TSSSGRSAVPRG

SEQ ID NO: 419 - protein, 12 aa, Artificial sequence
  an artificially synthesized sequence
TSSSGRSAIPRG

SEQ ID NO: 420 - protein, 12 aa, Artificial sequence
  an artificially synthesized sequence
TSSSGRSASPRG

SEQ ID NO: 421 - protein, 12 aa, Artificial sequence
  an artificially synthesized sequence
TSSSGRSAHPRG

SEQ ID NO: 422 - protein, 12 aa, Artificial sequence
  an artificially synthesized sequence
TSSSGRSANARG

SEQ ID NO: 423 - protein, 12 aa, Artificial sequence
  an artificially synthesized sequence
TSSSGRSANFRG

SEQ ID NO: 424 - protein, 12 aa, Artificial sequence
  an artificially synthesized sequence
TSSSGRSANYRG

SEQ ID NO: 425 - protein, 12 aa, Artificial sequence
  an artificially synthesized sequence
TSSSGRSANVRG

SEQ ID NO: 426 - protein, 12 aa, Artificial sequence
  an artificially synthesized sequence
TSSSGRSANHRG

SEQ ID NO: 427 - protein, 12 aa, Artificial sequence
  an artificially synthesized sequence
TSITGRSANPRG

SEQ ID NO: 428 - protein, 12 aa, Artificial sequence
  an artificially synthesized sequence
TSIKGRSANPRG

SEQ ID NO: 429 - protein, 12 aa, Artificial sequence
  an artificially synthesized sequence
TSISGRSAVPRG

SEQ ID NO: 430 - protein, 12 aa, Artificial sequence
  an artificially synthesized sequence
TSISGRSAIPRG

SEQ ID NO: 431 - protein, 12 aa, Artificial sequence
  an artificially synthesized sequence
TSISGRSATPRG

SEQ ID NO: 432 - protein, 12 aa, Artificial sequence
  an artificially synthesized sequence
TSISGRSASPRG

SEQ ID NO: 433 - protein, 12 aa, Artificial sequence
  an artificially synthesized sequence
TSISGRSAHPRG

SEQ ID NO: 434 - protein, 12 aa, Artificial sequence
  an artificially synthesized sequence
TSISGRSANARG

SEQ ID NO: 435 - protein, 12 aa, Artificial sequence
  an artificially synthesized sequence
TSISGRSANFRG

SEQ ID NO: 436 - protein, 12 aa, Artificial sequence
  an artificially synthesized sequence
TSISGRSANYRG

SEQ ID NO: 437 - protein, 12 aa, Artificial sequence
  an artificially synthesized sequence
TSISGRSANVRG

SEQ ID NO: 438 - protein, 12 aa, Artificial sequence
  an artificially synthesized sequence
TSISGRSANHRG

SEQ ID NO: 439 - protein, 12 aa, Artificial sequence
  an artificially synthesized sequence
TSTTGRSAVPRG

SEQ ID NO: 440 - protein, 12 aa, Artificial sequence
  an artificially synthesized sequence
TSTTGRSAIPRG

SEQ ID NO: 441 - protein, 12 aa, Artificial sequence
  an artificially synthesized sequence
TSTTGRSATPRG

SEQ ID NO: 442 - protein, 12 aa, Artificial sequence
  an artificially synthesized sequence
TSTTGRSAHPRG

SEQ ID NO: 443 - protein, 12 aa, Artificial sequence
  an artificially synthesized sequence
TSTTGRSANARG

SEQ ID NO: 444 - protein, 12 aa, Artificial sequence
  an artificially synthesized sequence
TSTTGRSANFRG

SEQ ID NO: 445 - protein, 12 aa, Artificial sequence
  an artificially synthesized sequence
TSTTGRSANYRG

SEQ ID NO: 446 - protein, 12 aa, Artificial sequence
  an artificially synthesized sequence
TSTTGRSANVRG

SEQ ID NO: 447 - protein, 12 aa, Artificial sequence
  an artificially synthesized sequence
TSTTGRSANHRG

SEQ ID NO: 448 - protein, 12 aa, Artificial sequence
  an artificially synthesized sequence
TSTKGRSAVPRG

SEQ ID NO: 449 - protein, 12 aa, Artificial sequence
  an artificially synthesized sequence
TSTKGRSAIPRG

SEQ ID NO: 450 - protein, 12 aa, Artificial sequence
  an artificially synthesized sequence
TSTKGRSATPRG

SEQ ID NO: 451 - protein, 12 aa, Artificial sequence
  an artificially synthesized sequence
TSTKGRSASPRG

SEQ ID NO: 452 - protein, 12 aa, Artificial sequence
  an artificially synthesized sequence
TSTKGRSAHPRG

SEQ ID NO: 453 - protein, 12 aa, Artificial sequence
  an artificially synthesized sequence
TSTKGRSANARG

SEQ ID NO: 454 - protein, 12 aa, Artificial sequence
  an artificially synthesized sequence
TSTKGRSANFRG

SEQ ID NO: 455 - protein, 12 aa, Artificial sequence
  an artificially synthesized sequence
TSTKGRSANYRG

SEQ ID NO: 456 - protein, 12 aa, Artificial sequence
  an artificially synthesized sequence
TSTKGRSANVRG

SEQ ID NO: 457 - protein, 12 aa, Artificial sequence
  an artificially synthesized sequence
TSTKGRSANHRG

SEQ ID NO: 458 - protein, 12 aa, Artificial sequence
  an artificially synthesized sequence
TSTSGRSAVYRG

SEQ ID NO: 459 - protein, 12 aa, Artificial sequence
  an artificially synthesized sequence
TSTSGRSAVVRG

SEQ ID NO: 460 - protein, 12 aa, Artificial sequence
  an artificially synthesized sequence
TSTSGRSAVHRG

SEQ ID NO: 461 - protein, 12 aa, Artificial sequence
  an artificially synthesized sequence
TSTSGRSAIYRG

SEQ ID NO: 462 - protein, 12 aa, Artificial sequence
  an artificially synthesized sequence
TSTSGRSAIVRG

SEQ ID NO: 463 - protein, 12 aa, Artificial sequence
  an artificially synthesized sequence
TSTSGRSAIHRG

SEQ ID NO: 464 - protein, 12 aa, Artificial sequence
  an artificially synthesized sequence
TSTSGRSASYRG

SEQ ID NO: 465 - protein, 12 aa, Artificial sequence
  an artificially synthesized sequence
TSTSGRSASVRG

SEQ ID NO: 466 - protein, 12 aa, Artificial sequence
  an artificially synthesized sequence
TSTSGRSASHRG

SEQ ID NO: 467 - protein, 12 aa, Artificial sequence
  an artificially synthesized sequence
TSTSGRSAHYRG

SEQ ID NO: 468 - protein, 12 aa, Artificial sequence
  an artificially synthesized sequence
TSTSGRSAHVRG

SEQ ID NO: 469 - protein, 12 aa, Artificial sequence
  an artificially synthesized sequence
TSTSGRSAHHRG

SEQ ID NO: 470 - protein, 12 aa, Artificial sequence
  an artificially synthesized sequence
TSPSGRSEVPRG

SEQ ID NO: 471 - protein, 12 aa, Artificial sequence
  an artificially synthesized sequence
TSPSGRSAEPRG

SEQ ID NO: 472 - protein, 12 aa, Artificial sequence
  an artificially synthesized sequence
TSPSGRSAGPRG

SEQ ID NO: 473 - protein, 12 aa, Artificial sequence
  an artificially synthesized sequence
TSASGRSENARG

SEQ ID NO: 474 - protein, 12 aa, Artificial sequence
  an artificially synthesized sequence
TSASGRSAEARG

SEQ ID NO: 475 - protein, 12 aa, Artificial sequence
  an artificially synthesized sequence
TSASGRSAGARG

SEQ ID NO: 476 - protein, 12 aa, Artificial sequence
  an artificially synthesized sequence
TSGTGRSATPRG

SEQ ID NO: 477 - protein, 12 aa, Artificial sequence
  an artificially synthesized sequence
TSGSGRSATYRG

SEQ ID NO: 478 - protein, 12 aa, Artificial sequence
  an artificially synthesized sequence
TSGSGRSATVRG

SEQ ID NO: 479 - protein, 12 aa, Artificial sequence
  an artificially synthesized sequence
TSGSGRSATHRG

SEQ ID NO: 480 - protein, 12 aa, Artificial sequence
  an artificially synthesized sequence
TSGTGRSATYRG

SEQ ID NO: 481 - protein, 12 aa, Artificial sequence
  an artificially synthesized sequence
TSGTGRSATVRG

SEQ ID NO: 482 - protein, 12 aa, Artificial sequence
  an artificially synthesized sequence
TSGTGRSATHRG

SEQ ID NO: 483 - protein, 12 aa, Artificial sequence
  an artificially synthesized sequence
TSGSGRSETPRG

SEQ ID NO: 484 - protein, 12 aa, Artificial sequence
  an artificially synthesized sequence
TSGTGRSETPRG

SEQ ID NO: 485 - protein, 12 aa, Artificial sequence
  an artificially synthesized sequence
TSGSGRSETYRG

SEQ ID NO: 486 - protein, 12 aa, Artificial sequence
  an artificially synthesized sequence
TSGSGRSETVRG

SEQ ID NO: 487 - protein, 12 aa, Artificial sequence
  an artificially synthesized sequence
TSGSGRSETHRG

SEQ ID NO: 488 - protein, 12 aa, Artificial sequence
  an artificially synthesized sequence
TSYTGRSAVPRG

SEQ ID NO: 489 - protein, 12 aa, Artificial sequence
  an artificially synthesized sequence
TSYSGRSAVYRG

SEQ ID NO: 490 - protein, 12 aa, Artificial sequence
  an artificially synthesized sequence
TSYSGRSAVVRG

SEQ ID NO: 491 - protein, 12 aa, Artificial sequence
  an artificially synthesized sequence
TSYSGRSAVHRG

SEQ ID NO: 492 - protein, 12 aa, Artificial sequence
  an artificially synthesized sequence
TSYTGRSAVYRG

SEQ ID NO: 493 - protein, 12 aa, Artificial sequence
  an artificially synthesized sequence
TSYTGRSAVVRG

SEQ ID NO: 494 - protein, 12 aa, Artificial sequence
  an artificially synthesized sequence
TSYTGRSAVHRG

SEQ ID NO: 495 - protein, 12 aa, Artificial sequence
  an artificially synthesized sequence
TSYSGRSEVPRG

SEQ ID NO: 496 - protein, 12 aa, Artificial sequence
  an artificially synthesized sequence
TSYTGRSEVPRG

SEQ ID NO: 497 - protein, 12 aa, Artificial sequence
  an artificially synthesized sequence
TSYSGRSEVYRG

SEQ ID NO: 498 - protein, 12 aa, Artificial sequence
  an artificially synthesized sequence
TSYSGRSEVVRG

SEQ ID NO: 499 - protein, 12 aa, Artificial sequence
  an artificially synthesized sequence
TSYSGRSEVHRG

SEQ ID NO: 500 - protein, 12 aa, Artificial sequence
  an artificially synthesized sequence
TSYTGRSAVPGG

SEQ ID NO: 501 - protein, 12 aa, Artificial sequence
  an artificially synthesized sequence
TSYSGRSAVYGG

SEQ ID NO: 502 - protein, 12 aa, Artificial sequence
  an artificially synthesized sequence
TSYSGRSAVVGG

SEQ ID NO: 503 - protein, 12 aa, Artificial sequence
  an artificially synthesized sequence
TSYSGRSAVHGG

SEQ ID NO: 504 - protein, 12 aa, Artificial sequence
  an artificially synthesized sequence
TSYTGRSAVYGG

SEQ ID NO: 505 - protein, 12 aa, Artificial sequence
  an artificially synthesized sequence
TSYTGRSAVVGG

SEQ ID NO: 506 - protein, 12 aa, Artificial sequence
  an artificially synthesized sequence
TSYTGRSAVHGG

SEQ ID NO: 507 - protein, 8 aa, Artificial sequence
  an artificially synthesized sequence
ASGRSANP

SEQ ID NO: 508 - protein, 8 aa, Artificial sequence
  an artificially synthesized sequence
ESGRSANP

SEQ ID NO: 509 - protein, 8 aa, Artificial sequence
  an artificially synthesized sequence
FSGRSANP

SEQ ID NO: 510 - protein, 8 aa, Artificial sequence
  an artificially synthesized sequence
GSGRSANP

SEQ ID NO: 511 - protein, 8 aa, Artificial sequence
  an artificially synthesized sequence
HSGRSANP

SEQ ID NO: 512 - protein, 8 aa, Artificial sequence
  an artificially synthesized sequence
KSGRSANP

SEQ ID NO: 513 - protein, 8 aa, Artificial sequence
  an artificially synthesized sequence
MSGRSANP

SEQ ID NO: 514 - protein, 8 aa, Artificial sequence
  an artificially synthesized sequence
NSGRSANP

SEQ ID NO: 515 - protein, 8 aa, Artificial sequence
  an artificially synthesized sequence
PSGRSANP

SEQ ID NO: 516 - protein, 8 aa, Artificial sequence
  an artificially synthesized sequence
QSGRSANP

SEQ ID NO: 517 - protein, 8 aa, Artificial sequence
  an artificially synthesized sequence
WSGRSANP

SEQ ID NO: 518 - protein, 8 aa, Artificial sequence
  an artificially synthesized sequence
YSGRSANP

SEQ ID NO: 519 - protein, 8 aa, Artificial sequence
  an artificially synthesized sequence
TAGRSANP

SEQ ID NO: 520 - protein, 8 aa, Artificial sequence
  an artificially synthesized sequence
TDGRSANP

SEQ ID NO: 521 - protein, 8 aa, Artificial sequence
  an artificially synthesized sequence
TEGRSANP

SEQ ID NO: 522 - protein, 8 aa, Artificial sequence
  an artificially synthesized sequence
TFGRSANP

SEQ ID NO: 523 - protein, 8 aa, Artificial sequence
  an artificially synthesized sequence
TLGRSANP

SEQ ID NO: 524 - protein, 8 aa, Artificial sequence
  an artificially synthesized sequence
TMGRSANP

SEQ ID NO: 525 - protein, 8 aa, Artificial sequence
  an artificially synthesized sequence
TPGRSANP

SEQ ID NO: 526 - protein, 8 aa, Artificial sequence
  an artificially synthesized sequence
TQGRSANP

SEQ ID NO: 527 - protein, 8 aa, Artificial sequence
  an artificially synthesized sequence
TVGRSANP

SEQ ID NO: 528 - protein, 8 aa, Artificial sequence
  an artificially synthesized sequence
TWGRSANP

SEQ ID NO: 529 - protein, 8 aa, Artificial sequence
  an artificially synthesized sequence
TSARSANP

SEQ ID NO: 530 - protein, 8 aa, Artificial sequence
  an artificially synthesized sequence
TSERSANP

SEQ ID NO: 531 - protein, 8 aa, Artificial sequence
  an artificially synthesized sequence
TSFRSANP

SEQ ID NO: 532 - protein, 8 aa, Artificial sequence
  an artificially synthesized sequence
TSHRSANP

SEQ ID NO: 533 - protein, 8 aa, Artificial sequence
  an artificially synthesized sequence
TSIRSANP

SEQ ID NO: 534 - protein, 8 aa, Artificial sequence
  an artificially synthesized sequence
TSKRSANP

SEQ ID NO: 535 - protein, 8 aa, Artificial sequence
  an artificially synthesized sequence
TSLRSANP

SEQ ID NO: 536 - protein, 8 aa, Artificial sequence
  an artificially synthesized sequence
TSMRSANP

SEQ ID NO: 537 - protein, 8 aa, Artificial sequence
  an artificially synthesized sequence
TSNRSANP

SEQ ID NO: 538 - protein, 8 aa, Artificial sequence
  an artificially synthesized sequence
TSPRSANP

SEQ ID NO: 539 - protein, 8 aa, Artificial sequence
  an artificially synthesized sequence
TSQRSANP

SEQ ID NO: 540 - protein, 8 aa, Artificial sequence
  an artificially synthesized sequence
TSRRSANP

SEQ ID NO: 541 - protein, 8 aa, Artificial sequence
  an artificially synthesized sequence
TSTRSANP

SEQ ID NO: 542 - protein, 8 aa, Artificial sequence
  an artificially synthesized sequence
TSVRSANP

SEQ ID NO: 543 - protein, 8 aa, Artificial sequence
  an artificially synthesized sequence
TSWRSANP

SEQ ID NO: 544 - protein, 8 aa, Artificial sequence
  an artificially synthesized sequence
TSYRSANP

SEQ ID NO: 545 - protein, 8 aa, Artificial sequence
  an artificially synthesized sequence
TSGRAANP

SEQ ID NO: 546 - protein, 8 aa, Artificial sequence
  an artificially synthesized sequence
TSGRDANP

SEQ ID NO: 547 - protein, 8 aa, Artificial sequence
  an artificially synthesized sequence
TSGREANP

SEQ ID NO: 548 - protein, 8 aa, Artificial sequence
  an artificially synthesized sequence
TSGRGANP

SEQ ID NO: 549 - protein, 8 aa, Artificial sequence
  an artificially synthesized sequence
TSGRHANP

SEQ ID NO: 550 - protein, 8 aa, Artificial sequence
  an artificially synthesized sequence
TSGRIANP

SEQ ID NO: 551 - protein, 8 aa, Artificial sequence
  an artificially synthesized sequence
TSGRKANP

SEQ ID NO: 552 - protein, 8 aa, Artificial sequence
  an artificially synthesized sequence
TSGRLANP

SEQ ID NO: 553 - protein, 8 aa, Artificial sequence
  an artificially synthesized sequence
TSGRMANP

SEQ ID NO: 554 - protein, 8 aa, Artificial sequence
  an artificially synthesized sequence
TSGRNANP

SEQ ID NO: 555 - protein, 8 aa, Artificial sequence
  an artificially synthesized sequence
TSGRPANP

SEQ ID NO: 556 - protein, 8 aa, Artificial sequence
  an artificially synthesized sequence
TSGRQANP

SEQ ID NO: 557 - protein, 8 aa, Artificial sequence
  an artificially synthesized sequence
TSGRRANP

SEQ ID NO: 558 - protein, 8 aa, Artificial sequence
  an artificially synthesized sequence
TSGRTANP

SEQ ID NO: 559 - protein, 8 aa, Artificial sequence
  an artificially synthesized sequence
TSGRVANP

SEQ ID NO: 560 - protein, 8 aa, Artificial sequence
  an artificially synthesized sequence
TSGRWANP

SEQ ID NO: 561 - protein, 8 aa, Artificial sequence
  an artificially synthesized sequence
TSGRYANP

SEQ ID NO: 562 - protein, 8 aa, Artificial sequence
  an artificially synthesized sequence
TSGRSENP

SEQ ID NO: 563 - protein, 8 aa, Artificial sequence
  an artificially synthesized sequence
TSGRSFNP

SEQ ID NO: 564 - protein, 8 aa, Artificial sequence
  an artificially synthesized sequence
TSGRSKNP

SEQ ID NO: 565 - protein, 8 aa, Artificial sequence
  an artificially synthesized sequence
TSGRSMNP

SEQ ID NO: 566 - protein, 8 aa, Artificial sequence
  an artificially synthesized sequence
TSGRSNNP

SEQ ID NO: 567 - protein, 8 aa, Artificial sequence
  an artificially synthesized sequence
TSGRSPNP

SEQ ID NO: 568 - protein, 8 aa, Artificial sequence
  an artificially synthesized sequence
TSGRSQNP

SEQ ID NO: 569 - protein, 8 aa, Artificial sequence
  an artificially synthesized sequence
TSGRSRNP

SEQ ID NO: 570 - protein, 8 aa, Artificial sequence
  an artificially synthesized sequence
TSGRSSNP

SEQ ID NO: 571 - protein, 8 aa, Artificial sequence
  an artificially synthesized sequence
TSGRSWNP

SEQ ID NO: 572 - protein, 8 aa, Artificial sequence
  an artificially synthesized sequence
TSGRSYNP

SEQ ID NO: 573 - protein, 8 aa, Artificial sequence
  an artificially synthesized sequence
TSGRSAAP

SEQ ID NO: 574 - protein, 8 aa, Artificial sequence
  an artificially synthesized sequence
TSGRSADP

SEQ ID NO: 575 - protein, 8 aa, Artificial sequence
  an artificially synthesized sequence
TSGRSAEP

SEQ ID NO: 576 - protein, 8 aa, Artificial sequence
  an artificially synthesized sequence
TSGRSAFP

SEQ ID NO: 577 - protein, 8 aa, Artificial sequence
  an artificially synthesized sequence
TSGRSAGP

SEQ ID NO: 578 - protein, 8 aa, Artificial sequence
  an artificially synthesized sequence
TSGRSAKP

SEQ ID NO: 579 - protein, 8 aa, Artificial sequence
  an artificially synthesized sequence
TSGRSALP

SEQ ID NO: 580 - protein, 8 aa, Artificial sequence
  an artificially synthesized sequence
TSGRSAMP

SEQ ID NO: 581 - protein, 8 aa, Artificial sequence
  an artificially synthesized sequence
TSGRSAPP

SEQ ID NO: 582 - protein, 8 aa, Artificial sequence
  an artificially synthesized sequence
TSGRSAQP

SEQ ID NO: 583 - protein, 8 aa, Artificial sequence
  an artificially synthesized sequence
TSGRSAVP

SEQ ID NO: 584 - protein, 8 aa, Artificial sequence
  an artificially synthesized sequence
TSGRSAWP

SEQ ID NO: 585 - protein, 8 aa, Artificial sequence
  an artificially synthesized sequence
TSGRSAYP

SEQ ID NO: 586 - protein, 8 aa, Artificial sequence
  an artificially synthesized sequence
TSGRSANA

SEQ ID NO: 587 - protein, 8 aa, Artificial sequence
  an artificially synthesized sequence
TSGRSAND

SEQ ID NO: 588 - protein, 8 aa, Artificial sequence
  an artificially synthesized sequence
TSGRSANE

SEQ ID NO: 589 - protein, 8 aa, Artificial sequence
  an artificially synthesized sequence
TSGRSANF

SEQ ID NO: 590 - protein, 8 aa, Artificial sequence
  an artificially synthesized sequence
TSGRSANG

SEQ ID NO: 591 - protein, 8 aa, Artificial sequence
  an artificially synthesized sequence
TSGRSANI

SEQ ID NO: 592 - protein, 8 aa, Artificial sequence
  an artificially synthesized sequence
TSGRSANK

SEQ ID NO: 593 - protein, 8 aa, Artificial sequence
  an artificially synthesized sequence
TSGRSANN

SEQ ID NO: 594 - protein, 8 aa, Artificial sequence
  an artificially synthesized sequence
TSGRSANQ

SEQ ID NO: 595 - protein, 8 aa, Artificial sequence
  an artificially synthesized sequence
TSGRSANS

SEQ ID NO: 596 - protein, 8 aa, Artificial sequence
  an artificially synthesized sequence
TSGRSANT

SEQ ID NO: 597 - protein, 8 aa, Artificial sequence
  an artificially synthesized sequence
TSGRSANW

SEQ ID NO: 598 - protein, 8 aa, Artificial sequence
  an artificially synthesized sequence
DSGRSANP

SEQ ID NO: 599 - protein, 8 aa, Artificial sequence
  an artificially synthesized sequence
ISGRSANP

SEQ ID NO: 600 - protein, 8 aa, Artificial sequence
  an artificially synthesized sequence
SSGRSANP

SEQ ID NO: 601 - protein, 8 aa, Artificial sequence
  an artificially synthesized sequence
THGRSANP

SEQ ID NO: 602 - protein, 8 aa, Artificial sequence
  an artificially synthesized sequence
TKGRSANP

SEQ ID NO: 603 - protein, 8 aa, Artificial sequence
  an artificially synthesized sequence
TTGRSANP

SEQ ID NO: 604 - protein, 8 aa, Artificial sequence
  an artificially synthesized sequence
TYGRSANP

SEQ ID NO: 605 - protein, 8 aa, Artificial sequence
  an artificially synthesized sequence
TSDRSANP

SEQ ID NO: 606 - protein, 8 aa, Artificial sequence
  an artificially synthesized sequence
TSSRSANP

SEQ ID NO: 607 - protein, 8 aa, Artificial sequence
  an artificially synthesized sequence
TSGRFANP

SEQ ID NO: 608 - protein, 8 aa, Artificial sequence
  an artificially synthesized sequence
TSGRSDNP

SEQ ID NO: 609 - protein, 8 aa, Artificial sequence
  an artificially synthesized sequence
TSGRSHNP

SEQ ID NO: 610 - protein, 8 aa, Artificial sequence
  an artificially synthesized sequence
TSGRSINP

SEQ ID NO: 611 - protein, 8 aa, Artificial sequence
  an artificially synthesized sequence
TSGRSLNP

SEQ ID NO: 612 - protein, 8 aa, Artificial sequence
  an artificially synthesized sequence
TSGRSTNP

SEQ ID NO: 613 - protein, 8 aa, Artificial sequence
  an artificially synthesized sequence
TSGRSVNP

SEQ ID NO: 614 - protein, 8 aa, Artificial sequence
  an artificially synthesized sequence
TSGRSAHP

SEQ ID NO: 615 - protein, 8 aa, Artificial sequence
  an artificially synthesized sequence
TSGRSAIP

SEQ ID NO: 616 - protein, 8 aa, Artificial sequence
  an artificially synthesized sequence
TSGRSARP

SEQ ID NO: 617 - protein, 8 aa, Artificial sequence
  an artificially synthesized sequence
TSGRSASP

SEQ ID NO: 618 - protein, 8 aa, Artificial sequence
  an artificially synthesized sequence
TSGRSATP

SEQ ID NO: 619 - protein, 8 aa, Artificial sequence
  an artificially synthesized sequence
TSGRSANH

SEQ ID NO: 620 - protein, 8 aa, Artificial sequence
  an artificially synthesized sequence
TSGRSANL

SEQ ID NO: 621 - protein, 8 aa, Artificial sequence
  an artificially synthesized sequence
TSGRSANM

SEQ ID NO: 622 - protein, 8 aa, Artificial sequence
  an artificially synthesized sequence
TSGRSANR

SEQ ID NO: 623 - protein, 8 aa, Artificial sequence
  an artificially synthesized sequence
TSGRSANV

SEQ ID NO: 624 - protein, 8 aa, Artificial sequence
  an artificially synthesized sequence
TSGRSANY

SEQ ID NO: 625 - protein, 8 aa, Artificial sequence
  an artificially synthesized sequence
GSGRSAVP

SEQ ID NO: 626 - protein, 8 aa, Artificial sequence
  an artificially synthesized sequence
GSGRSAYP

SEQ ID NO: 627 - protein, 8 aa, Artificial sequence
  an artificially synthesized sequence
GSGRSANQ

SEQ ID NO: 628 - protein, 8 aa, Artificial sequence
  an artificially synthesized sequence
GSGRSANA

SEQ ID NO: 629 - protein, 8 aa, Artificial sequence
  an artificially synthesized sequence
GSGRSANI

SEQ ID NO: 630 - protein, 8 aa, Artificial sequence
  an artificially synthesized sequence
GSGRSANF

SEQ ID NO: 631 - protein, 8 aa, Artificial sequence
  an artificially synthesized sequence
GSGRSANS

SEQ ID NO: 632 - protein, 8 aa, Artificial sequence
  an artificially synthesized sequence
QSGRSAVP

SEQ ID NO: 633 - protein, 8 aa, Artificial sequence
  an artificially synthesized sequence
QSGRSAYP

SEQ ID NO: 634 - protein, 8 aa, Artificial sequence
  an artificially synthesized sequence
QSGRSANQ

SEQ ID NO: 635 - protein, 8 aa, Artificial sequence
  an artificially synthesized sequence
QSGRSANA

SEQ ID NO: 636 - protein, 8 aa, Artificial sequence
  an artificially synthesized sequence
QSGRSANI

SEQ ID NO: 637 - protein, 8 aa, Artificial sequence
  an artificially synthesized sequence
QSGRSANF

SEQ ID NO: 638 - protein, 8 aa, Artificial sequence
  an artificially synthesized sequence
QSGRSANS

SEQ ID NO: 639 - protein, 8 aa, Artificial sequence
  an artificially synthesized sequence
PSGRSAVP

SEQ ID NO: 640 - protein, 8 aa, Artificial sequence
  an artificially synthesized sequence
PSGRSAYP

SEQ ID NO: 641 - protein, 8 aa, Artificial sequence
  an artificially synthesized sequence
PSGRSANQ

SEQ ID NO: 642 - protein, 8 aa, Artificial sequence
  an artificially synthesized sequence
PSGRSANA

SEQ ID NO: 643 - protein, 8 aa, Artificial sequence
  an artificially synthesized sequence
PSGRSANI

SEQ ID NO: 644 - protein, 8 aa, Artificial sequence
  an artificially synthesized sequence
PSGRSANF

SEQ ID NO: 645 - protein, 8 aa, Artificial sequence
  an artificially synthesized sequence
PSGRSANS

SEQ ID NO: 646 - protein, 8 aa, Artificial sequence
  an artificially synthesized sequence
ASGRSAVP

SEQ ID NO: 647 - protein, 8 aa, Artificial sequence
  an artificially synthesized sequence
ASGRSAYP

SEQ ID NO: 648 - protein, 8 aa, Artificial sequence
  an artificially synthesized sequence
ASGRSANQ

SEQ ID NO: 649 - protein, 8 aa, Artificial sequence
  an artificially synthesized sequence
ASGRSANA

SEQ ID NO: 650 - protein, 8 aa, Artificial sequence
  an artificially synthesized sequence
ASGRSANI

SEQ ID NO: 651 - protein, 8 aa, Artificial sequence
  an artificially synthesized sequence
ASGRSANF

SEQ ID NO: 652 - protein, 8 aa, Artificial sequence
  an artificially synthesized sequence
ASGRSANS

SEQ ID NO: 653 - protein, 8 aa, Artificial sequence
  an artificially synthesized sequence
YSGRSENP

SEQ ID NO: 654 - protein, 8 aa, Artificial sequence
  an artificially synthesized sequence
GSGRSENP

SEQ ID NO: 655 - protein, 8 aa, Artificial sequence
  an artificially synthesized sequence
QSGRSENP

SEQ ID NO: 656 - protein, 8 aa, Artificial sequence
  an artificially synthesized sequence
PSGRSENP

SEQ ID NO: 657 - protein, 8 aa, Artificial sequence
  an artificially synthesized sequence
ASGRSENP

SEQ ID NO: 658 - protein, 8 aa, Artificial sequence
  an artificially synthesized sequence
HSGRSENP

SEQ ID NO: 659 - protein, 8 aa, Artificial sequence
  an artificially synthesized sequence
TSGRSENQ

SEQ ID NO: 660 - protein, 8 aa, Artificial sequence
  an artificially synthesized sequence
TSGRSENA

SEQ ID NO: 661 - protein, 8 aa, Artificial sequence
  an artificially synthesized sequence
TSGRSENI

SEQ ID NO: 662 - protein, 8 aa, Artificial sequence
  an artificially synthesized sequence
TSGRSENF

SEQ ID NO: 663 - protein, 8 aa, Artificial sequence
  an artificially synthesized sequence
TSGRSENS

SEQ ID NO: 664 - protein, 8 aa, Artificial sequence
  an artificially synthesized sequence
YSGRSAEP

SEQ ID NO: 665 - protein, 8 aa, Artificial sequence
  an artificially synthesized sequence
GSGRSAEP

SEQ ID NO: 666 - protein, 8 aa, Artificial sequence
  an artificially synthesized sequence
QSGRSAEP

SEQ ID NO: 667 - protein, 8 aa, Artificial sequence
  an artificially synthesized sequence
PSGRSAEP

SEQ ID NO: 668 - protein, 8 aa, Artificial sequence
  an artificially synthesized sequence
ASGRSAEP

SEQ ID NO: 669 - protein, 8 aa, Artificial sequence
  an artificially synthesized sequence
HSGRSAEP

SEQ ID NO: 670 - protein, 8 aa, Artificial sequence
  an artificially synthesized sequence
TSGRSAEQ

SEQ ID NO: 671 - protein, 8 aa, Artificial sequence
  an artificially synthesized sequence
TSGRSAEA

SEQ ID NO: 672 - protein, 8 aa, Artificial sequence
  an artificially synthesized sequence
TSGRSAEI

SEQ ID NO: 673 - protein, 8 aa, Artificial sequence
  an artificially synthesized sequence
TSGRSAEF

SEQ ID NO: 674 - protein, 8 aa, Artificial sequence
  an artificially synthesized sequence
TSGRSAES

SEQ ID NO: 675 - protein, 8 aa, Artificial sequence
  an artificially synthesized sequence
GTGRSANP

SEQ ID NO: 676 - protein, 8 aa, Artificial sequence
  an artificially synthesized sequence
GKGRSANP

SEQ ID NO: 677 - protein, 8 aa, Artificial sequence
  an artificially synthesized sequence
GSGRSAIP

SEQ ID NO: 678 - protein, 8 aa, Artificial sequence
  an artificially synthesized sequence
GSGRSATP

SEQ ID NO: 679 - protein, 8 aa, Artificial sequence
  an artificially synthesized sequence
GSGRSASP

SEQ ID NO: 680 - protein, 8 aa, Artificial sequence
  an artificially synthesized sequence
GSGRSAHP

SEQ ID NO: 681 - protein, 8 aa, Artificial sequence
  an artificially synthesized sequence
GSGRSANY

SEQ ID NO: 682 - protein, 8 aa, Artificial sequence
  an artificially synthesized sequence
GSGRSANV

SEQ ID NO: 683 - protein, 8 aa, Artificial sequence
  an artificially synthesized sequence
GSGRSANH

SEQ ID NO: 684 - protein, 8 aa, Artificial sequence
  an artificially synthesized sequence
QTGRSANP

SEQ ID NO: 685 - protein, 8 aa, Artificial sequence
  an artificially synthesized sequence
QKGRSANP

SEQ ID NO: 686 - protein, 8 aa, Artificial sequence
  an artificially synthesized sequence
QSGRSAIP

SEQ ID NO: 687 - protein, 8 aa, Artificial sequence
  an artificially synthesized sequence
QSGRSATP

SEQ ID NO: 688 - protein, 8 aa, Artificial sequence
  an artificially synthesized sequence
QSGRSASP

SEQ ID NO: 689 - protein, 8 aa, Artificial sequence
  an artificially synthesized sequence
QSGRSAHP

SEQ ID NO: 690 - protein, 8 aa, Artificial sequence
  an artificially synthesized sequence
QSGRSANY

SEQ ID NO: 691 - protein, 8 aa, Artificial sequence
  an artificially synthesized sequence
QSGRSANV

SEQ ID NO: 692 - protein, 8 aa, Artificial sequence
  an artificially synthesized sequence
QSGRSANH

SEQ ID NO: 693 - protein, 8 aa, Artificial sequence
  an artificially synthesized sequence
PTGRSANP

SEQ ID NO: 694 - protein, 8 aa, Artificial sequence
  an artificially synthesized sequence
PKGRSANP

SEQ ID NO: 695 - protein, 8 aa, Artificial sequence
  an artificially synthesized sequence
PSGRSAIP

SEQ ID NO: 696 - protein, 8 aa, Artificial sequence
  an artificially synthesized sequence
PSGRSATP

SEQ ID NO: 697 - protein, 8 aa, Artificial sequence
  an artificially synthesized sequence
PSGRSASP

SEQ ID NO: 698 - protein, 8 aa, Artificial sequence
  an artificially synthesized sequence
PSGRSAHP

SEQ ID NO: 699 - protein, 8 aa, Artificial sequence
  an artificially synthesized sequence
PSGRSANY

SEQ ID NO: 700 - protein, 8 aa, Artificial sequence
  an artificially synthesized sequence
PSGRSANV

SEQ ID NO: 701 - protein, 8 aa, Artificial sequence
  an artificially synthesized sequence
PSGRSANH

SEQ ID NO: 702 - protein, 8 aa, Artificial sequence
  an artificially synthesized sequence
ATGRSANP

SEQ ID NO: 703 - protein, 8 aa, Artificial sequence
  an artificially synthesized sequence
AKGRSANP

SEQ ID NO: 704 - protein, 8 aa, Artificial sequence
  an artificially synthesized sequence
ASGRSAIP

SEQ ID NO: 705 - protein, 8 aa, Artificial sequence
  an artificially synthesized sequence
ASGRSATP

SEQ ID NO: 706 - protein, 8 aa, Artificial sequence
  an artificially synthesized sequence
ASGRSASP

SEQ ID NO: 707 - protein, 8 aa, Artificial sequence
  an artificially synthesized sequence
ASGRSAHP

SEQ ID NO: 708 - protein, 8 aa, Artificial sequence
  an artificially synthesized sequence
ASGRSANY

SEQ ID NO: 709 - protein, 8 aa, Artificial sequence
  an artificially synthesized sequence
ASGRSANV

SEQ ID NO: 710 - protein, 8 aa, Artificial sequence
  an artificially synthesized sequence
ASGRSANH

SEQ ID NO: 711 - protein, 8 aa, Artificial sequence
  an artificially synthesized sequence
YTGRSANP

SEQ ID NO: 712 - protein, 8 aa, Artificial sequence
  an artificially synthesized sequence
YKGRSANP

SEQ ID NO: 713 - protein, 8 aa, Artificial sequence
  an artificially synthesized sequence
YSGRSAVP

SEQ ID NO: 714 - protein, 8 aa, Artificial sequence
  an artificially synthesized sequence
YSGRSAIP

SEQ ID NO: 715 - protein, 8 aa, Artificial sequence
  an artificially synthesized sequence
YSGRSATP

SEQ ID NO: 716 - protein, 8 aa, Artificial sequence
  an artificially synthesized sequence
YSGRSASP

SEQ ID NO: 717 - protein, 8 aa, Artificial sequence
  an artificially synthesized sequence
YSGRSAHP

SEQ ID NO: 718 - protein, 8 aa, Artificial sequence
  an artificially synthesized sequence
YSGRSANA

SEQ ID NO: 719 - protein, 8 aa, Artificial sequence
  an artificially synthesized sequence
YSGRSANF

SEQ ID NO: 720 - protein, 8 aa, Artificial sequence
  an artificially synthesized sequence
YSGRSANY

SEQ ID NO: 721 - protein, 8 aa, Artificial sequence
  an artificially synthesized sequence
YSGRSANV

SEQ ID NO: 722 - protein, 8 aa, Artificial sequence
  an artificially synthesized sequence
YSGRSANH

SEQ ID NO: 723 - protein, 8 aa, Artificial sequence
  an artificially synthesized sequence
STGRSANP

SEQ ID NO: 724 - protein, 8 aa, Artificial sequence
  an artificially synthesized sequence
SKGRSANP

SEQ ID NO: 725 - protein, 8 aa, Artificial sequence
  an artificially synthesized sequence
SSGRSAVP

SEQ ID NO: 726 - protein, 8 aa, Artificial sequence
  an artificially synthesized sequence
SSGRSAIP

SEQ ID NO: 727 - protein, 8 aa, Artificial sequence
  an artificially synthesized sequence
SSGRSATP

SEQ ID NO: 728 - protein, 8 aa, Artificial sequence
  an artificially synthesized sequence
SSGRSASP

SEQ ID NO: 729 - protein, 8 aa, Artificial sequence
  an artificially synthesized sequence
SSGRSAHP

SEQ ID NO: 730 - protein, 8 aa, Artificial sequence
  an artificially synthesized sequence
SSGRSANA

SEQ ID NO: 731 - protein, 8 aa, Artificial sequence
  an artificially synthesized sequence
SSGRSANF

SEQ ID NO: 732 - protein, 8 aa, Artificial sequence
  an artificially synthesized sequence
SSGRSANY

SEQ ID NO: 733 - protein, 8 aa, Artificial sequence
  an artificially synthesized sequence
SSGRSANV

SEQ ID NO: 734 - protein, 8 aa, Artificial sequence
  an artificially synthesized sequence
SSGRSANH

SEQ ID NO: 735 - protein, 8 aa, Artificial sequence
  an artificially synthesized sequence
ITGRSANP

SEQ ID NO: 736 - protein, 8 aa, Artificial sequence
  an artificially synthesized sequence
IKGRSANP

SEQ ID NO: 737 - protein, 8 aa, Artificial sequence
  an artificially synthesized sequence
ISGRSAVP

SEQ ID NO: 738 - protein, 8 aa, Artificial sequence
  an artificially synthesized sequence
ISGRSAIP

SEQ ID NO: 739 - protein, 8 aa, Artificial sequence
  an artificially synthesized sequence
ISGRSATP

SEQ ID NO: 740 - protein, 8 aa, Artificial sequence
  an artificially synthesized sequence
ISGRSASP

SEQ ID NO: 741 - protein, 8 aa, Artificial sequence
  an artificially synthesized sequence
ISGRSAHP

SEQ ID NO: 742 - protein, 8 aa, Artificial sequence
  an artificially synthesized sequence
ISGRSANA

SEQ ID NO: 743 - protein, 8 aa, Artificial sequence
  an artificially synthesized sequence
ISGRSANF

SEQ ID NO: 744 - protein, 8 aa, Artificial sequence
  an artificially synthesized sequence
ISGRSANY

SEQ ID NO: 745 - protein, 8 aa, Artificial sequence
  an artificially synthesized sequence
ISGRSANV

SEQ ID NO: 746 - protein, 8 aa, Artificial sequence
  an artificially synthesized sequence
ISGRSANH

SEQ ID NO: 747 - protein, 8 aa, Artificial sequence
  an artificially synthesized sequence
TTGRSAVP

SEQ ID NO: 748 - protein, 8 aa, Artificial sequence
  an artificially synthesized sequence
TTGRSAIP

SEQ ID NO: 749 - protein, 8 aa, Artificial sequence
  an artificially synthesized sequence
TTGRSATP

SEQ ID NO: 750 - protein, 8 aa, Artificial sequence
  an artificially synthesized sequence
TTGRSASP

SEQ ID NO: 751 - protein, 8 aa, Artificial sequence
  an artificially synthesized sequence
TTGRSAHP

SEQ ID NO: 752 - protein, 8 aa, Artificial sequence
  an artificially synthesized sequence
TTGRSANA

SEQ ID NO: 753 - protein, 8 aa, Artificial sequence
  an artificially synthesized sequence
TTGRSANF

SEQ ID NO: 754 - protein, 8 aa, Artificial sequence
  an artificially synthesized sequence
TTGRSANY

SEQ ID NO: 755 - protein, 8 aa, Artificial sequence
  an artificially synthesized sequence
TTGRSANV

SEQ ID NO: 756 - protein, 8 aa, Artificial sequence
  an artificially synthesized sequence
TTGRSANH

SEQ ID NO: 757 - protein, 8 aa, Artificial sequence
  an artificially synthesized sequence
TKGRSAVP

SEQ ID NO: 758 - protein, 8 aa, Artificial sequence
  an artificially synthesized sequence
TKGRSAIP

SEQ ID NO: 759 - protein, 8 aa, Artificial sequence
  an artificially synthesized sequence
TKGRSATP

SEQ ID NO: 760 - protein, 8 aa, Artificial sequence
  an artificially synthesized sequence
TKGRSASP

SEQ ID NO: 761 - protein, 8 aa, Artificial sequence
  an artificially synthesized sequence
TKGRSAHP

SEQ ID NO: 762 - protein, 8 aa, Artificial sequence
  an artificially synthesized sequence
TKGRSANA

SEQ ID NO: 763 - protein, 8 aa, Artificial sequence
  an artificially synthesized sequence
TKGRSANF

SEQ ID NO: 764 - protein, 8 aa, Artificial sequence
  an artificially synthesized sequence
TKGRSANY

SEQ ID NO: 765 - protein, 8 aa, Artificial sequence
  an artificially synthesized sequence
TKGRSANV

SEQ ID NO: 766 - protein, 8 aa, Artificial sequence
  an artificially synthesized sequence
TKGRSANH

SEQ ID NO: 767 - protein, 8 aa, Artificial sequence
  an artificially synthesized sequence
TSGRSAVY

SEQ ID NO: 768 - protein, 8 aa, Artificial sequence
  an artificially synthesized sequence
TSGRSAVV

SEQ ID NO: 769 - protein, 8 aa, Artificial sequence
  an artificially synthesized sequence
TSGRSAVH

SEQ ID NO: 770 - protein, 8 aa, Artificial sequence
  an artificially synthesized sequence
TSGRSAIY

SEQ ID NO: 771 - protein, 8 aa, Artificial sequence
  an artificially synthesized sequence
TSGRSAIV

SEQ ID NO: 772 - protein, 8 aa, Artificial sequence
  an artificially synthesized sequence
TSGRSAIH

SEQ ID NO: 773 - protein, 8 aa, Artificial sequence
  an artificially synthesized sequence
TSGRSASY

SEQ ID NO: 774 - protein, 8 aa, Artificial sequence
  an artificially synthesized sequence
TSGRSASV

SEQ ID NO: 775 - protein, 8 aa, Artificial sequence
  an artificially synthesized sequence
TSGRSASH

SEQ ID NO: 776 - protein, 8 aa, Artificial sequence
  an artificially synthesized sequence
TSGRSAHY

SEQ ID NO: 777 - protein, 8 aa, Artificial sequence
  an artificially synthesized sequence
TSGRSAHV

SEQ ID NO: 778 - protein, 8 aa, Artificial sequence
  an artificially synthesized sequence
TSGRSAHH

SEQ ID NO: 779 - protein, 8 aa, Artificial sequence
  an artificially synthesized sequence
PSGRSEVP

SEQ ID NO: 780 - protein, 8 aa, Artificial sequence
  an artificially synthesized sequence
PSGRSAEP

SEQ ID NO: 781 - protein, 8 aa, Artificial sequence
  an artificially synthesized sequence
PSGRSAGP

SEQ ID NO: 782 - protein, 8 aa, Artificial sequence
  an artificially synthesized sequence
ASGRSENA

SEQ ID NO: 783 - protein, 8 aa, Artificial sequence
  an artificially synthesized sequence
ASGRSAEA

SEQ ID NO: 784 - protein, 8 aa, Artificial sequence
  an artificially synthesized sequence
ASGRSAGA

SEQ ID NO: 785 - protein, 8 aa, Artificial sequence
  an artificially synthesized sequence
GTGRSATP

SEQ ID NO: 786 - protein, 8 aa, Artificial sequence
  an artificially synthesized sequence
GSGRSATY

SEQ ID NO: 787 - protein, 8 aa, Artificial sequence
  an artificially synthesized sequence
GSGRSATV

SEQ ID NO: 788 - protein, 8 aa, Artificial sequence
  an artificially synthesized sequence
GSGRSATH

SEQ ID NO: 789 - protein, 8 aa, Artificial sequence
  an artificially synthesized sequence
GTGRSATY

SEQ ID NO: 790 - protein, 8 aa, Artificial sequence
  an artificially synthesized sequence
GTGRSATV

SEQ ID NO: 791 - protein, 8 aa, Artificial sequence
  an artificially synthesized sequence
GTGRSATH

SEQ ID NO: 792 - protein, 8 aa, Artificial sequence
  an artificially synthesized sequence
GSGRSETP

SEQ ID NO: 793 - protein, 8 aa, Artificial sequence
  an artificially synthesized sequence
GTGRSETP

SEQ ID NO: 794 - protein, 8 aa, Artificial sequence
  an artificially synthesized sequence
GSGRSETY

SEQ ID NO: 795 - protein, 8 aa, Artificial sequence
  an artificially synthesized sequence
GSGRSETV

SEQ ID NO: 796 - protein, 8 aa, Artificial sequence
  an artificially synthesized sequence
GSGRSETH

SEQ ID NO: 797 - protein, 8 aa, Artificial sequence
  an artificially synthesized sequence
YTGRSAVP

SEQ ID NO: 798 - protein, 8 aa, Artificial sequence
  an artificially synthesized sequence
YSGRSAVY

SEQ ID NO: 799 - protein, 8 aa, Artificial sequence
  an artificially synthesized sequence
YSGRSAVV

SEQ ID NO: 800 - protein, 8 aa, Artificial sequence
  an artificially synthesized sequence
YSGRSAVH

SEQ ID NO: 801 - protein, 8 aa, Artificial sequence
  an artificially synthesized sequence
YTGRSAVY

SEQ ID NO: 802 - protein, 8 aa, Artificial sequence
  an artificially synthesized sequence
YTGRSAVV

SEQ ID NO: 803 - protein, 8 aa, Artificial sequence
  an artificially synthesized sequence
YTGRSAVH

SEQ ID NO: 804 - protein, 8 aa, Artificial sequence
  an artificially synthesized sequence
YSGRSEVP

SEQ ID NO: 805 - protein, 8 aa, Artificial sequence
  an artificially synthesized sequence
YTGRSEVP

SEQ ID NO: 806 - protein, 8 aa, Artificial sequence
  an artificially synthesized sequence
YSGRSEVY

SEQ ID NO: 807 - protein, 8 aa, Artificial sequence
  an artificially synthesized sequence
YSGRSEVV

SEQ ID NO: 808 - protein, 8 aa, Artificial sequence
  an artificially synthesized sequence
YSGRSEVH

SEQ ID NO: 809 - protein, 8 aa, Artificial sequence
  an artificially synthesized sequence
YTGRSAVP

SEQ ID NO: 810 - protein, 8 aa, Artificial sequence
  an artificially synthesized sequence
YSGRSAVY

SEQ ID NO: 811 - protein, 8 aa, Artificial sequence
  an artificially synthesized sequence
YSGRSAVV

SEQ ID NO: 812 - protein, 8 aa, Artificial sequence
  an artificially synthesized sequence
YSGRSAVH

SEQ ID NO: 813 - protein, 8 aa, Artificial sequence
  an artificially synthesized sequence
YTGRSAVY

SEQ ID NO: 814 - protein, 8 aa, Artificial sequence
  an artificially synthesized sequence
YTGRSAVV

SEQ ID NO: 815 - protein, 8 aa, Artificial sequence
  an artificially synthesized sequence
YTGRSAVH

SEQ ID NO: 816 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSTSGRSANPRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 817 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVPRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 818 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVYRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 819 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVVRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 820 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVHRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 821 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVYRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 822 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVVRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 823 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVHRGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 824 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVPGGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 825 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVYGGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 826 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVVGGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 827 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVHGGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 828 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVYGGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 829 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVVGGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 830 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVHGGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 831 - protein, 462 aa, Artificial sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 832 - protein, 216 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 833 - protein, 8 aa, Artificial sequence
  Recombinant polypeptide
  MISC_FEATURE (1)..(1): Xaa can be Ala, Asp, Glu, Phe, Gly, His, Ile, Lys, Met, Asn, Pro, Gln, Ser, Thr, Trp, or Tyr
  MISC_FEATURE (2)..(2): Xaa can be Ala, Asp, Glu, Phe, His, Lys, Leu, Met, Pro, Gln, Ser, Thr, Val, Trp, or Tyr
  MISC_FEATURE (3)..(3): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (4)..(4): Xaa is Arg
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa can be Ala, Asp, Glu, Phe, His, Ile, Lys, Leu, Met, Asn, Pro, Gln, Arg, Ser, Thr, Val, Trp, or Ty r
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, Gly, His, Ile, Lys, Leu, Met, Asn, Pro, Gln, Arg, Ser, Thr, Val, Trp, or Tyr
XXXXXXXX

SEQ ID NO: 834 - protein, 8 aa, Artificial sequence
  Recombinant polypeptide
  MISC_FEATURE (1)..(1): Xaa can be Ala, Glu, Phe, Gly, His, Lys, Met, Asn, Pro, Gln, Trp, or Tyr
  MISC_FEATURE (2)..(2): Xaa can be Ala, Asp, Glu, Phe, His, Lys, Leu, Met, Pro, Gln, Ser, Thr, Val, Trp, or Tyr
  MISC_FEATURE (3)..(3): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (4)..(4): Xaa is Arg
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa can be Ala, Asp, Glu, Phe, His, Ile, Lys, Leu, Met, Asn, Pro, Gln, Arg, Ser, Thr, Val, Trp, or Ty r
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, Gly, His, Ile, Lys, Leu, Met, Asn, Pro, Gln, Arg, Ser, Thr, Val, Trp, or Tyr
XXXXXXXX

SEQ ID NO: 835 - protein, 8 aa, Artificial sequence
  Recombinant polypeptide
  MISC_FEATURE (1)..(1): Xaa can be Ala, Asp, Glu, Phe, Gly, His, Ile, Lys, Met, Asn, Pro, Gln, Ser, Thr, Trp, or Tyr
  MISC_FEATURE (2)..(2): Xaa can be Ala, Asp, Phe, Leu, Met, Pro, Gln, Val, Trp, or Tyr
  MISC_FEATURE (3)..(3): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (4)..(4): Xaa is Arg
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa can be Ala, Asp, Glu, Phe, His, Ile, Lys, Leu, Met, Asn, Pro, Gln, Arg, Ser, Thr, Val, Trp, or Ty r
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, Gly, His, Ile, Lys, Leu, Met, Asn, Pro, Gln, Arg, Ser, Thr, Val, Trp, or Tyr
XXXXXXXX

SEQ ID NO: 836 - protein, 8 aa, Artificial sequence
  Recombinant polypeptide
  MISC_FEATURE (1)..(1): Xaa can be Ala, Asp, Glu, Phe, Gly, His, Ile, Lys, Met, Asn, Pro, Gln, Ser, Thr, Trp, or Tyr
  MISC_FEATURE (2)..(2): Xaa can be Ala, Asp, Glu, Phe, His, Lys, Leu, Met, Pro, Gln, Ser, Thr, Val, Trp, or Tyr
  MISC_FEATURE (3)..(3): Xaa can be Ala, Glu, Phe, His, Ile, Lys, Leu, Met, Asn, Pro, Gln, Arg, Thr, Val, Trp, or Tyr X4 is Arg
  MISC_FEATURE (4)..(4): Xaa is Arg
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa can be Ala, Asp, Glu, Phe, His, Ile, Lys, Leu, Met, Asn, Pro, Gln, Arg, Ser, Thr, Val, Trp, or Ty r
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, Gly, His, Ile, Lys, Leu, Met, Asn, Pro, Gln, Arg, Ser, Thr, Val, Trp, or Tyr
XXXXXXXX

SEQ ID NO: 837 - protein, 8 aa, Artificial sequence
  Recombinant polypeptide
  MISC_FEATURE (1)..(1): Xaa can be Ala, Asp, Glu, Phe, Gly, His, Ile, Lys, Met, Asn, Pro, Gln, Ser, Thr, Trp, or Tyr
  MISC_FEATURE (2)..(2): Xaa can be Ala, Asp, Glu, Phe, His, Lys, Leu, Met, Pro, Gln, Ser, Thr, Val, Trp, or Tyr
  MISC_FEATURE (3)..(3): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (4)..(4): Xaa is Arg
  MISC_FEATURE (5)..(5): Xaa can be Ala, Asp, Glu, Gly, His, Ile, Lys, Leu, Met, Asn, Gln, Arg, Thr, Val, Trp, or Tyr
  MISC_FEATURE (6)..(6): Xaa can be Ala, Asp, Glu, Phe, His, Ile, Lys, Leu, Met, Asn, Pro, Gln, Arg, Ser, Thr, Val, Trp, or Ty r
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, Gly, His, Ile, Lys, Leu, Met, Asn, Pro, Gln, Arg, Ser, Thr, Val, Trp, or Tyr
XXXXXXXX

SEQ ID NO: 838 - protein, 8 aa, Artificial sequence
  Recombinant polypeptide
  MISC_FEATURE (1)..(1): Xaa can be Ala, Asp, Glu, Phe, Gly, His, Ile, Lys, Met, Asn, Pro, Gln, Ser, Thr, Trp, or Tyr
  MISC_FEATURE (2)..(2): Xaa can be Ala, Asp, Glu, Phe, His, Lys, Leu, Met, Pro, Gln, Ser, Thr, Val, Trp, or Tyr
  MISC_FEATURE (3)..(3): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (4)..(4): Xaa is Arg
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa can be Glu, Phe, Lys, Met, Asn, Pro, Gln, Arg, Ser, or Trp
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, Gly, His, Ile, Lys, Leu, Met, Asn, Pro, Gln, Arg, Ser, Thr, Val, Trp, or Tyr
XXXXXXXX

SEQ ID NO: 839 - protein, 8 aa, Artificial sequence
  Recombinant polypeptide
  MISC_FEATURE (1)..(1): Xaa can be Ala, Asp, Glu, Phe, Gly, His, Ile, Lys, Met, Asn, Pro, Gln, Ser, Thr, Trp, or Tyr
  MISC_FEATURE (2)..(2): Xaa can be Ala, Asp, Glu, Phe, His, Lys, Leu, Met, Pro, Gln, Ser, Thr, Val, Trp, or Tyr
  MISC_FEATURE (3)..(3): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (4)..(4): Xaa is Arg
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa can be Ala, Asp, Glu, Phe, His, Ile, Lys, Leu, Met, Asn, Pro, Gln, Arg, Ser, Thr, Val, Trp, or Ty r
  MISC_FEATURE (7)..(7): Xaa can be Ala, Asp, Phe, Gly, Leu, Met, Pro, Gln, Val, or Trp
  MISC_FEATURE (8)..(8): Xaa can be Ala, Asp, Glu, Phe, Gly, His, Ile, Lys, Leu, Met, Asn, Pro, Gln, Arg, Ser, Thr, Val, Trp, or Tyr
XXXXXXXX

SEQ ID NO: 840 - protein, 8 aa, Artificial sequence
  Recombinant polypeptide
  MISC_FEATURE (1)..(1): Xaa can be Ala, Asp, Glu, Phe, Gly, His, Ile, Lys, Met, Asn, Pro, Gln, Ser, Thr, Trp, or Tyr
  MISC_FEATURE (2)..(2): Xaa can be Ala, Asp, Glu, Phe, His, Lys, Leu, Met, Pro, Gln, Ser, Thr, Val, Trp, or Tyr
  MISC_FEATURE (3)..(3): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (4)..(4): Xaa is  Arg
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa can be Ala, Asp, Glu, Phe, His, Ile, Lys, Leu, Met, Asn, Pro, Gln, Arg, Ser, Thr, Val, Trp, or Ty r
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, Gly, Ile, Lys, Asn, Thr, or Trp
XXXXXXXX

SEQ ID NO: 841 - protein, 8 aa, Artificial sequence
  Recombinant polypeptide
  MISC_FEATURE (1)..(1): Xaa can be Ala, Gly, Ile, Pro, Gln, Ser, or Tyr
  MISC_FEATURE (2)..(2): Xaa can be Lys, or Thr
  MISC_FEATURE (3)..(3): Xaa is Gly
  MISC_FEATURE (4)..(4): Xaa is Arg
  MISC_FEATURE (5)..(5): Xaa is Ser
  MISC_FEATURE (6)..(6): Xaa is Ala
  MISC_FEATURE (7)..(7): Xaa can be His, Ile, or  Val
  MISC_FEATURE (8)..(8): Xaa can be His, Val, or Tyr
XXXXXXXX

SEQ ID NO: 842 - protein, 8 aa, Artificial sequence
  Recombinant polypeptide
  MISC_FEATURE (1)..(1): Xaa is Tyr
  MISC_FEATURE (2)..(2): Xaa can be Ser, or Thr
  MISC_FEATURE (3)..(3): Xaa is Gly
  MISC_FEATURE (4)..(4): Xaa is Arg
  MISC_FEATURE (5)..(5): Xaa is Ser
  MISC_FEATURE (6)..(6): Xaa can be Ala or Glu
  MISC_FEATURE (7)..(7): Xaa can be Asn or Val
  MISC_FEATURE (8)..(8): Xaa can be His, Pro, Val, or Tyr
XXXXXXXX

SEQ ID NO: 843 - protein, 9 aa, Artificial sequence
  Recombinant polypeptide
  MISC_FEATURE (1)..(1): Xaa can be Ala, Asp, Glu, Phe, Gly, His, Ile, Lys, Met, Asn, Pro, Gln, Ser, Thr, Trp, or Tyr
  MISC_FEATURE (2)..(2): Xaa can be Ala, Asp, Glu, Phe, His, Lys, Leu, Met, Pro, Gln, Ser, Thr, Val, Trp, or Tyr
  MISC_FEATURE (3)..(3): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (4)..(4): Xaa is Arg
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa can be Ala, Asp, Glu, Phe, His, Ile, Lys, Leu, Met, Asn, Pro, Gln, Arg, Ser, Thr, Val, Trp, or Ty r
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (9)..(9): Xaa can be Ala, Gly, His, Ile, Leu, or Arg
XXXXXXXXX

SEQ ID NO: 844 - protein, 9 aa, Artificial sequence
  Recombinant polypeptide
  MISC_FEATURE (1)..(1): Xaa can be Ala, Glu, Phe, Gly, His, Lys, Met, Asn, Pro, Gln, Trp, or Tyr
  MISC_FEATURE (2)..(2): Xaa can be Ala, Asp, Glu, Phe, His, Lys, Leu, Met, Pro, Gln, Ser, Thr, Val, Trp, or Tyr
  MISC_FEATURE (3)..(3): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (4)..(4): Xaa is Arg
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa can be Ala, Asp, Glu, Phe, His, Ile, Lys, Leu, Met, Asn, Pro, Gln, Arg, Ser, Thr, Val, Trp, or Ty r
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, Gly, His, Ile, Lys, Leu, Met, Asn, Pro, Gln, Arg, Ser, Thr, Val, Trp, or Tyr; and
  MISC_FEATURE (9)..(9): Xaa can be Ala, Gly, His, Ile, Leu, or Arg
XXXXXXXXX

SEQ ID NO: 845 - protein, 9 aa, Artificial sequence
  Recombinant polypeptide
  MISC_FEATURE (1)..(1): Xaa can be Ala, Asp, Glu, Phe, Gly, His, Ile, Lys, Met, Asn, Pro, Gln, Ser, Thr, Trp, or Tyr
  MISC_FEATURE (2)..(2): Xaa can be Ala, Asp, Phe, Leu, Met, Pro, Gln, Val, Trp, or Tyr
  MISC_FEATURE (3)..(3): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (4)..(4): Xaa is Arg
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa can be Ala, Asp, Glu, Phe, His, Ile, Lys, Leu, Met, Asn, Pro, Gln, Arg, Ser, Thr, Val, Trp, or Ty r
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (9)..(9): Xaa can be Ala, Gly, His, Ile, Leu, or Arg
XXXXXXXXX

SEQ ID NO: 846 - protein, 9 aa, Artificial sequence
  Recombinant polypeptide
  MISC_FEATURE (1)..(1): Xaa can be Ala, Asp, Glu, Phe, Gly, His, Ile, Lys, Met, Asn, Pro, Gln, Ser, Thr, Trp, or Tyr
  MISC_FEATURE (2)..(2): Xaa can be Ala, Asp, Glu, Phe, His, Lys, Leu, Met, Pro, Gln, Ser, Thr, Val, Trp, or Tyr
  MISC_FEATURE (3)..(3): Xaa can be Ala, Glu, Phe, His, Ile, Lys, Leu, Met, Asn, Pro, Gln, Arg, Thr, Val, Trp, or Tyr X4 is Arg
  MISC_FEATURE (4)..(4): Xaa is Arg
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa can be Ala, Asp, Glu, Phe, His, Ile, Lys, Leu, Met, Asn, Pro, Gln, Arg, Ser, Thr, Val, Trp, or Ty r
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (9)..(9): Xaa can be Ala, Gly, His, Ile, Leu, or Arg
XXXXXXXXX

SEQ ID NO: 847 - protein, 9 aa, Artificial sequence
  Recombinant polypeptide
  MISC_FEATURE (1)..(1): Xaa can be Ala, Asp, Glu, Phe, Gly, His, Ile, Lys, Met, Asn, Pro, Gln, Ser, Thr, Trp, or Tyr
  MISC_FEATURE (2)..(2): Xaa can be Ala, Asp, Glu, Phe, His, Lys, Leu, Met, Pro, Gln, Ser, Thr, Val, Trp, or Tyr
  MISC_FEATURE (3)..(3): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (4)..(4): Xaa is Arg can be
  MISC_FEATURE (5)..(5): Xaa can be Ala, Asp, Glu, Gly, His, Ile, Lys, Leu, Met, Asn, Gln, Arg, Thr, Val, Trp, or Tyr
  MISC_FEATURE (6)..(6): Xaa can be Ala, Asp, Glu, Phe, His, Ile, Lys, Leu, Met, Asn, Pro, Gln, Arg, Ser, Thr, Val, Trp, or Ty r
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (9)..(9): Xaa can be Ala, Gly, His, Ile, Leu, or Arg
XXXXXXXXX

SEQ ID NO: 848 - protein, 9 aa, Artificial sequence
  Recombinant polypeptide
  MISC_FEATURE (1)..(1): Xaa can be Ala, Asp, Glu, Phe, Gly, His, Ile, Lys, Met, Asn, Pro, Gln, Ser, Thr, Trp, or Tyr
  MISC_FEATURE (2)..(2): Xaa can be Ala, Asp, Glu, Phe, His, Lys, Leu, Met, Pro, Gln, Ser, Thr, Val, Trp, or Tyr
  MISC_FEATURE (3)..(3): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (4)..(4): Xaa is Arg
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa can be Glu, Phe, Lys, Met, Asn, Pro, Gln, Arg, Ser, or Trp
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (9)..(9): Xaa can be Ala, Gly, His, Ile, Leu, or Arg
XXXXXXXXX

SEQ ID NO: 849 - protein, 9 aa, Artificial sequence
  Recombinant polypeptide
  MISC_FEATURE (1)..(1): Xaa can be Ala, Asp, Glu, Phe, Gly, His, Ile, Lys, Met, Asn, Pro, Gln, Ser, Thr, Trp, or Tyr
  MISC_FEATURE (2)..(2): Xaa can be Ala, Asp, Glu, Phe, His, Lys, Leu, Met, Pro, Gln, Ser, Thr, Val, Trp, or Tyr
  MISC_FEATURE (3)..(3): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (4)..(4): Xaa is Arg
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa can be Ala, Asp, Glu, Phe, His, Ile, Lys, Leu, Met, Asn, Pro, Gln, Arg, Ser, Thr, Val, Trp, or Ty r
  MISC_FEATURE (7)..(7): Xaa can be Ala, Asp, Phe, Gly, Leu, Met, Pro, Gln, Val, or Trp
  MISC_FEATURE (8)..(8): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (9)..(9): Xaa can be Ala, Gly, His, Ile, Leu, or Arg
XXXXXXXXX

SEQ ID NO: 850 - protein, 9 aa, Artificial sequence
  Recombinant polypeptide
  MISC_FEATURE (1)..(1): Xaa can be Ala, Asp, Glu, Phe, Gly, His, Ile, Lys, Met, Asn, Pro, Gln, Ser, Thr, Trp, or Tyr
  MISC_FEATURE (2)..(2): Xaa can be Ala, Asp, Glu, Phe, His, Lys, Leu, Met, Pro, Gln, Ser, Thr, Val, Trp, or Tyr
  MISC_FEATURE (3)..(3): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (4)..(4): Xaa is Arg
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa can be Ala, Asp, Glu, Phe, His, Ile, Lys, Leu, Met, Asn, Pro, Gln, Arg, Ser, Thr, Val, Trp, or Ty r
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, Gly, Ile, Lys, Asn, Thr, or Trp
  MISC_FEATURE (9)..(9): Xaa can be Ala, Gly, His, Ile, Leu, or Arg
XXXXXXXXX

SEQ ID NO: 851 - protein, 9 aa, Artificial sequence
  Recombinant polypeptide
  MISC_FEATURE (1)..(1): Xaa can be Ala, Gly, Ile, Pro, Gln, Ser, or Tyr
  MISC_FEATURE (2)..(2): Xaa can be Lys, or Thr
  MISC_FEATURE (3)..(3): Xaa is Gly
  MISC_FEATURE (4)..(4): Xaa is Arg
  MISC_FEATURE (5)..(5): Xaa is Ser
  MISC_FEATURE (6)..(6): Xaa is Ala
  MISC_FEATURE (7)..(7): Xaa can be His, Ile, or Val
  MISC_FEATURE (8)..(8): Xaa can be His, Val, or Tyr
  MISC_FEATURE (9)..(9): Xaa can be Ala, Gly, His, Ile, Leu, or Arg
XXXXXXXXX

SEQ ID NO: 852 - protein, 9 aa, Artificial sequence
  Recombinant polypeptide
  MISC_FEATURE (1)..(1): Xaa is Tyr
  MISC_FEATURE (2)..(2): Xaa can be Ser, or Thr
  MISC_FEATURE (3)..(3): Xaa is Gly
  MISC_FEATURE (4)..(4): Xaa is Arg
  MISC_FEATURE (5)..(5): Xaa is Ser
  MISC_FEATURE (6)..(6): Xaa can be Ala, or Glu
  MISC_FEATURE (7)..(7): Xaa can be His, Ile, or Val
  MISC_FEATURE (8)..(8): Xaa can be His, Pro, Val, or Tyr
  MISC_FEATURE (9)..(9): Xaa can be Ala, Gly, His, Ile, Leu, or Arg
XXXXXXXXX

SEQ ID NO: 853 - protein, 12 aa, Artificial sequence
  an artificially synthesized sequence
TSTSGRSANPRG

SEQ ID NO: 854 - protein, 12 aa, Artificial sequence
  an artificially synthesized sequence
TSTSGRSANPAG

SEQ ID NO: 855 - protein, 12 aa, Artificial sequence
  an artificially synthesized sequence
TSTSGRSANPHG

SEQ ID NO: 856 - protein, 12 aa, Artificial sequence
  an artificially synthesized sequence
TSTSGRSANPIG

SEQ ID NO: 857 - protein, 12 aa, Artificial sequence
  an artificially synthesized sequence
TSTSGRSANPLG

SEQ ID NO: 858 - protein, 12 aa, Artificial sequence
  an artificially synthesized sequence
TSTSGRSANPSG

SEQ ID NO: 859 - protein, 12 aa, Artificial sequence
  an artificially synthesized sequence
ISTSGRSANPIG

SEQ ID NO: 860 - protein, 12 aa, Artificial sequence
  an artificially synthesized sequence
YSTSGRSANPIG

SEQ ID NO: 861 - protein, 12 aa, Artificial sequence
  an artificially synthesized sequence
TSYSGRSAVPAG

SEQ ID NO: 862 - protein, 12 aa, Artificial sequence
  an artificially synthesized sequence
TSPSGRSANIAG

SEQ ID NO: 863 - protein, 12 aa, Artificial sequence
  an artificially synthesized sequence
TSPSGRSANFAG

SEQ ID NO: 864 - protein, 12 aa, Artificial sequence
  an artificially synthesized sequence
TSPTGRSANPAG

SEQ ID NO: 865 - protein, 12 aa, Artificial sequence
  an artificially synthesized sequence
TSPSGRSAIPAG

SEQ ID NO: 866 - protein, 12 aa, Artificial sequence
  an artificially synthesized sequence
TSYTGRSANPAG

SEQ ID NO: 867 - protein, 12 aa, Artificial sequence
  an artificially synthesized sequence
TSYSGRSAIPAG

SEQ ID NO: 868 - protein, 12 aa, Artificial sequence
  an artificially synthesized sequence
TSISGRSANYAG

SEQ ID NO: 869 - protein, 12 aa, Artificial sequence
  an artificially synthesized sequence
TSPSGRSAGPAG

SEQ ID NO: 870 - protein, 12 aa, Artificial sequence
  an artificially synthesized sequence
TSYTGRSAVPAG

SEQ ID NO: 871 - protein, 12 aa, Artificial sequence
  an artificially synthesized sequence
TSYTGRSAVYAG

SEQ ID NO: 872 - protein, 12 aa, Artificial sequence
  an artificially synthesized sequence
TSYTGRSAVVAG

SEQ ID NO: 873 - protein, 12 aa, Artificial sequence
  an artificially synthesized sequence
TSYTGRSAVHAG

SEQ ID NO: 874 - protein, 12 aa, Artificial sequence
  an artificially synthesized sequence
TSYSGRSAVPHG

SEQ ID NO: 875 - protein, 12 aa, Artificial sequence
  an artificially synthesized sequence
TSPSGRSANIHG

SEQ ID NO: 876 - protein, 12 aa, Artificial sequence
  an artificially synthesized sequence
TSPSGRSANFHG

SEQ ID NO: 877 - protein, 12 aa, Artificial sequence
  an artificially synthesized sequence
TSPTGRSANPHG

SEQ ID NO: 878 - protein, 12 aa, Artificial sequence
  an artificially synthesized sequence
TSPSGRSAIPHG

SEQ ID NO: 879 - protein, 12 aa, Artificial sequence
  an artificially synthesized sequence
TSYTGRSANPHG

SEQ ID NO: 880 - protein, 12 aa, Artificial sequence
  an artificially synthesized sequence
TSYSGRSAIPHG

SEQ ID NO: 881 - protein, 12 aa, Artificial sequence
  an artificially synthesized sequence
TSISGRSANYHG

SEQ ID NO: 882 - protein, 12 aa, Artificial sequence
  an artificially synthesized sequence
TSPSGRSAGPHG

SEQ ID NO: 883 - protein, 12 aa, Artificial sequence
  an artificially synthesized sequence
TSYTGRSAVPHG

SEQ ID NO: 884 - protein, 12 aa, Artificial sequence
  an artificially synthesized sequence
TSYTGRSAVYHG

SEQ ID NO: 885 - protein, 12 aa, Artificial sequence
  an artificially synthesized sequence
TSYTGRSAVVHG

SEQ ID NO: 886 - protein, 12 aa, Artificial sequence
  an artificially synthesized sequence
TSYTGRSAVHHG

SEQ ID NO: 887 - protein, 12 aa, Artificial sequence
  an artificially synthesized sequence
TSYSGRSAVPIG

SEQ ID NO: 888 - protein, 12 aa, Artificial sequence
  an artificially synthesized sequence
TSPSGRSANIIG

SEQ ID NO: 889 - protein, 12 aa, Artificial sequence
  an artificially synthesized sequence
TSPSGRSANFIG

SEQ ID NO: 890 - protein, 12 aa, Artificial sequence
  an artificially synthesized sequence
TSPTGRSANPIG

SEQ ID NO: 891 - protein, 12 aa, Artificial sequence
  an artificially synthesized sequence
TSPSGRSAIPIG

SEQ ID NO: 892 - protein, 12 aa, Artificial sequence
  an artificially synthesized sequence
TSYTGRSANPIG

SEQ ID NO: 893 - protein, 12 aa, Artificial sequence
  an artificially synthesized sequence
TSYSGRSAIPIG

SEQ ID NO: 894 - protein, 12 aa, Artificial sequence
  an artificially synthesized sequence
TSISGRSANYIG

SEQ ID NO: 895 - protein, 12 aa, Artificial sequence
  an artificially synthesized sequence
TSPSGRSAGPIG

SEQ ID NO: 896 - protein, 12 aa, Artificial sequence
  an artificially synthesized sequence
TSYTGRSAVPIG

SEQ ID NO: 897 - protein, 12 aa, Artificial sequence
  an artificially synthesized sequence
TSYTGRSAVYIG

SEQ ID NO: 898 - protein, 12 aa, Artificial sequence
  an artificially synthesized sequence
TSYTGRSAVVIG

SEQ ID NO: 899 - protein, 12 aa, Artificial sequence
  an artificially synthesized sequence
TSYTGRSAVHIG

SEQ ID NO: 900 - protein, 12 aa, Artificial sequence
  an artificially synthesized sequence
TSYSGRSAVPLG

SEQ ID NO: 901 - protein, 12 aa, Artificial sequence
  an artificially synthesized sequence
TSPSGRSANILG

SEQ ID NO: 902 - protein, 12 aa, Artificial sequence
  an artificially synthesized sequence
TSPSGRSANFLG

SEQ ID NO: 903 - protein, 12 aa, Artificial sequence
  an artificially synthesized sequence
TSPTGRSANPLG

SEQ ID NO: 904 - protein, 12 aa, Artificial sequence
  an artificially synthesized sequence
TSPSGRSAIPLG

SEQ ID NO: 905 - protein, 12 aa, Artificial sequence
  an artificially synthesized sequence
TSYTGRSANPLG

SEQ ID NO: 906 - protein, 12 aa, Artificial sequence
  an artificially synthesized sequence
TSYSGRSAIPLG

SEQ ID NO: 907 - protein, 12 aa, Artificial sequence
  an artificially synthesized sequence
TSISGRSANYLG

SEQ ID NO: 908 - protein, 12 aa, Artificial sequence
  an artificially synthesized sequence
TSPSGRSAGPLG

SEQ ID NO: 909 - protein, 12 aa, Artificial sequence
  an artificially synthesized sequence
TSYTGRSAVPLG

SEQ ID NO: 910 - protein, 12 aa, Artificial sequence
  an artificially synthesized sequence
TSYTGRSAVYLG

SEQ ID NO: 911 - protein, 12 aa, Artificial sequence
  an artificially synthesized sequence
TSYTGRSAVVLG

SEQ ID NO: 912 - protein, 12 aa, Artificial sequence
  an artificially synthesized sequence
TSYTGRSAVHLG

SEQ ID NO: 913 - protein, 12 aa, Artificial sequence
  an artificially synthesized sequence
TSYSGRSAVPSG

SEQ ID NO: 914 - protein, 12 aa, Artificial sequence
  an artificially synthesized sequence
TSPSGRSANISG

SEQ ID NO: 915 - protein, 12 aa, Artificial sequence
  an artificially synthesized sequence
TSPSGRSANFSG

SEQ ID NO: 916 - protein, 12 aa, Artificial sequence
  an artificially synthesized sequence
TSPTGRSANPSG

SEQ ID NO: 917 - protein, 12 aa, Artificial sequence
  an artificially synthesized sequence
TSPSGRSAIPSG

SEQ ID NO: 918 - protein, 12 aa, Artificial sequence
  an artificially synthesized sequence
TSYTGRSANPSG

SEQ ID NO: 919 - protein, 12 aa, Artificial sequence
  an artificially synthesized sequence
TSYSGRSAIPSG

SEQ ID NO: 920 - protein, 12 aa, Artificial sequence
  an artificially synthesized sequence
TSISGRSANYSG

SEQ ID NO: 921 - protein, 12 aa, Artificial sequence
  an artificially synthesized sequence
TSPSGRSAGPSG

SEQ ID NO: 922 - protein, 12 aa, Artificial sequence
  an artificially synthesized sequence
TSYTGRSAVPSG

SEQ ID NO: 923 - protein, 12 aa, Artificial sequence
  an artificially synthesized sequence
TSYTGRSAVYSG

SEQ ID NO: 924 - protein, 12 aa, Artificial sequence
  an artificially synthesized sequence
TSYTGRSAVVSG

SEQ ID NO: 925 - protein, 12 aa, Artificial sequence
  an artificially synthesized sequence
TSYTGRSAVHSG

SEQ ID NO: 926 - protein, 12 aa, Artificial sequence
  an artificially synthesized sequence
ISYSGRSAVPIG

SEQ ID NO: 927 - protein, 12 aa, Artificial sequence
  an artificially synthesized sequence
ISPSGRSANIIG

SEQ ID NO: 928 - protein, 12 aa, Artificial sequence
  an artificially synthesized sequence
ISPSGRSANFIG

SEQ ID NO: 929 - protein, 12 aa, Artificial sequence
  an artificially synthesized sequence
ISPTGRSANPIG

SEQ ID NO: 930 - protein, 12 aa, Artificial sequence
  an artificially synthesized sequence
ISPSGRSAIPIG

SEQ ID NO: 931 - protein, 12 aa, Artificial sequence
  an artificially synthesized sequence
ISYTGRSANPIG

SEQ ID NO: 932 - protein, 12 aa, Artificial sequence
  an artificially synthesized sequence
ISYSGRSAIPIG

SEQ ID NO: 933 - protein, 12 aa, Artificial sequence
  an artificially synthesized sequence
ISISGRSANYIG

SEQ ID NO: 934 - protein, 12 aa, Artificial sequence
  an artificially synthesized sequence
ISPSGRSAGPIG

SEQ ID NO: 935 - protein, 12 aa, Artificial sequence
  an artificially synthesized sequence
ISYTGRSAVPIG

SEQ ID NO: 936 - protein, 12 aa, Artificial sequence
  an artificially synthesized sequence
ISYTGRSAVYIG

SEQ ID NO: 937 - protein, 12 aa, Artificial sequence
  an artificially synthesized sequence
ISYTGRSAVVIG

SEQ ID NO: 938 - protein, 12 aa, Artificial sequence
  an artificially synthesized sequence
ISYTGRSAVHIG

SEQ ID NO: 939 - protein, 12 aa, Artificial sequence
  an artificially synthesized sequence
YSYSGRSAVPIG

SEQ ID NO: 940 - protein, 12 aa, Artificial sequence
  an artificially synthesized sequence
YSPSGRSANIIG

SEQ ID NO: 941 - protein, 12 aa, Artificial sequence
  an artificially synthesized sequence
YSPSGRSANFIG

SEQ ID NO: 942 - protein, 12 aa, Artificial sequence
  an artificially synthesized sequence
YSPTGRSANPIG

SEQ ID NO: 943 - protein, 12 aa, Artificial sequence
  an artificially synthesized sequence
YSPSGRSAIPIG

SEQ ID NO: 944 - protein, 12 aa, Artificial sequence
  an artificially synthesized sequence
YSYTGRSANPIG

SEQ ID NO: 945 - protein, 12 aa, Artificial sequence
  an artificially synthesized sequence
YSYSGRSAIPIG

SEQ ID NO: 946 - protein, 12 aa, Artificial sequence
  an artificially synthesized sequence
YSISGRSANYIG

SEQ ID NO: 947 - protein, 12 aa, Artificial sequence
  an artificially synthesized sequence
YSPSGRSAGPIG

SEQ ID NO: 948 - protein, 12 aa, Artificial sequence
  an artificially synthesized sequence
YSYTGRSAVPIG

SEQ ID NO: 949 - protein, 12 aa, Artificial sequence
  an artificially synthesized sequence
YSYTGRSAVYIG

SEQ ID NO: 950 - protein, 12 aa, Artificial sequence
  an artificially synthesized sequence
YSYTGRSAVVIG

SEQ ID NO: 951 - protein, 12 aa, Artificial sequence
  an artificially synthesized sequence
YSYTGRSAVHIG

SEQ ID NO: 952 - protein, 228 aa, Artificial sequence; identical to SEQ ID NO: 816
  an artificially synthesized sequence

SEQ ID NO: 953 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSTSGRSANPAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 954 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSTSGRSANPHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 955 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSTSGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 956 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSTSGRSANPLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 957 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSTSGRSANPSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 958 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISTSGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 959 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSTSGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 960 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVPAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 961 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANIAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 962 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANFAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 963 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPTGRSANPAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 964 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAIPAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 965 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSANPAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 966 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAIPAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 967 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSISGRSANYAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 968 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAGPAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 969 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVPAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 970 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVYAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 971 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVVAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 972 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVHAGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 973 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVPHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 974 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANIHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 975 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANFHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 976 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPTGRSANPHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 977 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAIPHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 978 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSANPHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 979 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAIPHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 980 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSISGRSANYHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 981 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAGPHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 982 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVPHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 983 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVYHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 984 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVVHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 985 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVHHGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 986 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 987 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANIIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 988 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANFIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 989 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPTGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 990 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAIPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 991 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 992 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAIPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 993 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSISGRSANYIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 994 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAGPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 995 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 996 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVYIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 997 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVVIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 998 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVHIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 999 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVPLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1000 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANILGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1001 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANFLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1002 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPTGRSANPLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1003 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAIPLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1004 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSANPLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1005 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAIPLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1006 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSISGRSANYLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1007 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAGPLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1008 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVPLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1009 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVYLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1010 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVVLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1011 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVHLGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1012 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAVPSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1013 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANISGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1014 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSANFSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1015 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPTGRSANPSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1016 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAIPSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1017 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSANPSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1018 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYSGRSAIPSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1019 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSISGRSANYSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1020 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSPSGRSAGPSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1021 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVPSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1022 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVYSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1023 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVVSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1024 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLTSYTGRSAVHSGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1025 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISYSGRSAVPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1026 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISPSGRSANIIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1027 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISPSGRSANFIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1028 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISPTGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1029 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISPSGRSAIPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1030 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISYTGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1031 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISYSGRSAIPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1032 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISISGRSANYIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1033 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISPSGRSAGPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1034 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISYTGRSAVPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1035 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISYTGRSAVYIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1036 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISYTGRSAVVIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1037 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLISYTGRSAVHIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1038 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSYSGRSAVPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1039 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSPSGRSANIIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1040 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSPSGRSANFIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1041 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSPTGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1042 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSPSGRSAIPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1043 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSYTGRSANPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1044 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSYSGRSAIPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1045 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSISGRSANYIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1046 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSPSGRSAGPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1047 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSYTGRSAVPIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1048 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSYTGRSAVYIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1049 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSYTGRSAVVIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1050 - protein, 228 aa, Artificial sequence
  an artificially synthesized sequence
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLYSYTGRSAVHIGGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1051 - protein, 462 aa, Artificial sequence
  an artificially synthesized sequence
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPYLDSDGSFFLYSKLTVDKSRWQQGNVFSCSVMHEALHNHYTQKSLSLSP

SEQ ID NO: 1052 - protein, 12 aa, Artificial sequence
  an artificially synthesized sequence
TSYTGRSAVPRG

SEQ ID NO: 1053 - protein, 12 aa, Artificial sequence
  an artificially synthesized sequence
TSYSGRSAVVRG

SEQ ID NO: 1054 - protein, 12 aa, Artificial sequence
  an artificially synthesized sequence
TSYTGRSAVYRG

SEQ ID NO: 1055 - protein, 12 aa, Artificial sequence
  an artificially synthesized sequence
TSYTGRSAVHRG

SEQ ID NO: 1056 - protein, 228 aa, Artificial sequence; identical to SEQ ID NO: 817
  an artificially synthesized sequence

SEQ ID NO: 1057 - protein, 228 aa, Artificial sequence; identical to SEQ ID NO: 819
  an artificially synthesized sequence

SEQ ID NO: 1058 - protein, 228 aa, Artificial sequence; identical to SEQ ID NO: 821
  an artificially synthesized sequence

SEQ ID NO: 1059 - protein, 228 aa, Artificial sequence; identical to SEQ ID NO: 823
  an artificially synthesized sequence

SEQ ID NO: 1060 - protein, 444 aa, Artificial sequence
  an artificially synthesized sequence
QVQLQQSGPQLVRPGASVKISCKASGYSFTSYWMHWVNQRPGQGLEWIGMIDPSYSETRLNQKFKDKATLTVDKSSSTAYMQLSSPTSEDSAVYYCALYGNYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1061 - protein, 214 aa, Artificial sequence
  an artificially synthesized sequence
DIQMTQSSSSFSVSLGDRVTITCKASEDIYNRLAWYQQKPGNAPRLLISGATSLETGVPSRFSGSGSGKDYTLSITSLQTEDVATYYCQQYWSTPYTFGGGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1062 - protein, 10 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Asp, Glu, Phe, Gly, His, Ile, Lys, Met, Asn, Pro, Gln, Ser, Thr, Trp, or Tyr
  MISC_FEATURE (4)..(4): Xaa can be Ala, Asp, Glu, Phe, His, Lys, Leu, Met, Pro, Gln, Ser, Thr, Val, Trp, or Tyr
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa is Arg
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, His, Ile, Lys, Leu, Met, Asn, Pro, Gln, Arg, Ser, Thr, Val, Trp, or Ty r
  MISC_FEATURE (9)..(9): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (10)..(10): Xaa can be Ala, Asp, Glu, Phe, Gly, His, Ile, Lys, Leu, Met, Asn, Pro, Gln, Arg, Ser, Thr, Val, Trp, or Tyr
XXXXXXXXXX

SEQ ID NO: 1063 - protein, 10 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Glu, Phe, Gly, His, Lys, Met, Asn, Pro, Gln, Trp, or Tyr
  MISC_FEATURE (4)..(4): Xaa can be Ala, Asp, Glu, Phe, His, Lys, Leu, Met, Pro, Gln, Ser, Thr, Val, Trp, or Tyr
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa is Arg
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, His, Ile, Lys, Leu, Met, Asn, Pro, Gln, Arg, Ser, Thr, Val, Trp, or Ty r
  MISC_FEATURE (9)..(9): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (10)..(10): Xaa can be Ala, Asp, Glu, Phe, Gly, His, Ile, Lys, Leu, Met, Asn, Pro, Gln, Arg, Ser, Thr, Val, Trp, or Tyr
XXXXXXXXXX

SEQ ID NO: 1064 - protein, 10 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Asp, Glu, Phe, Gly, His, Ile, Lys, Met, Asn, Pro, Gln, Ser, Thr, Trp, or Tyr
  MISC_FEATURE (4)..(4): Xaa can be Ala, Asp, Phe, Leu, Met, Pro, Gln, Val, Trp, or Tyr
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa is Arg
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, His, Ile, Lys, Leu, Met, Asn, Pro, Gln, Arg, Ser, Thr, Val, Trp, or Ty r
  MISC_FEATURE (9)..(9): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (10)..(10): Xaa can be Ala, Asp, Glu, Phe, Gly, His, Ile, Lys, Leu, Met, Asn, Pro, Gln, Arg, Ser, Thr, Val, Trp, or Tyr
XXXXXXXXXX

SEQ ID NO: 1065 - protein, 10 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Asp, Glu, Phe, Gly, His, Ile, Lys, Met, Asn, Pro, Gln, Ser, Thr, Trp, or Tyr
  MISC_FEATURE (4)..(4): Xaa can be Ala, Asp, Glu, Phe, His, Lys, Leu, Met, Pro, Gln, Ser, Thr, Val, Trp, or Tyr
  MISC_FEATURE (5)..(5): Xaa can be Ala, Glu, Phe, His, Ile, Lys, Leu, Met, Asn, Pro, Gln, Arg, Thr, Val, Trp, or Tyr
  MISC_FEATURE (6)..(6): Xaa is Arg
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, His, Ile, Lys, Leu, Met, Asn, Pro, Gln, Arg, Ser, Thr, Val, Trp, or Ty r
  MISC_FEATURE (9)..(9): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (10)..(10): Xaa can be Ala, Asp, Glu, Phe, Gly, His, Ile, Lys, Leu, Met, Asn, Pro, Gln, Arg, Ser, Thr, Val, Trp, or Tyr
XXXXXXXXXX

SEQ ID NO: 1066 - protein, 10 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Asp, Glu, Phe, Gly, His, Ile, Lys, Met, Asn, Pro, Gln, Ser, Thr, Trp, or Tyr
  MISC_FEATURE (4)..(4): Xaa can be Ala, Asp, Glu, Phe, His, Lys, Leu, Met, Pro, Gln, Ser, Thr, Val, Trp, or Tyr
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa is Arg
  MISC_FEATURE (7)..(7): Xaa can be Ala, Asp, Glu, Gly, His, Ile, Lys, Leu, Met, Asn, Gln, Arg, Thr, Val, Trp, or Tyr
  MISC_FEATURE (8)..(8): Xaa can be Ala, Asp, Glu, Phe, His, Ile, Lys, Leu, Met, Asn, Pro, Gln, Arg, Ser, Thr, Val, Trp, or Ty r
  MISC_FEATURE (9)..(9): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (10)..(10): Xaa can be Ala, Asp, Glu, Phe, Gly, His, Ile, Lys, Leu, Met, Asn, Pro, Gln, Arg, Ser, Thr, Val, Trp, or Tyr
XXXXXXXXXX

SEQ ID NO: 1067 - protein, 10 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Asp, Glu, Phe, Gly, His, Ile, Lys, Met, Asn, Pro, Gln, Ser, Thr, Trp, or Tyr
  MISC_FEATURE (4)..(4): Xaa can be Ala, Asp, Glu, Phe, His, Lys, Leu, Met, Pro, Gln, Ser, Thr, Val, Trp, or Tyr
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa is Arg
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Glu, Phe, Lys, Met, Asn, Pro, Gln, Arg, Ser, or Trp
  MISC_FEATURE (9)..(9): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (10)..(10): Xaa can be Ala, Asp, Glu, Phe, Gly, His, Ile, Lys, Leu, Met, Asn, Pro, Gln, Arg, Ser, Thr, Val, Trp, or Tyr.
XXXXXXXXXX

SEQ ID NO: 1068 - protein, 10 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Asp, Glu, Phe, Gly, His, Ile, Lys, Met, Asn, Pro, Gln, Ser, Thr, Trp, or Tyr
  MISC_FEATURE (4)..(4): Xaa can be Ala, Asp, Glu, Phe, His, Lys, Leu, Met, Pro, Gln, Ser, Thr, Val, Trp, or Tyr
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa is Arg
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, His, Ile, Lys, Leu, Met, Asn, Pro, Gln, Arg, Ser, Thr, Val, Trp, or Ty r
  MISC_FEATURE (9)..(9): Xaa can be Ala, Asp, Phe, Gly, Leu, Met, Pro, Gln, Val, or Trp
  MISC_FEATURE (10)..(10): Xaa can be Ala, Asp, Glu, Phe, Gly, His, Ile, Lys, Leu, Met, Asn, Pro, Gln, Arg, Ser, Thr, Val, Trp, or Tyr
XXXXXXXXXX

SEQ ID NO: 1069 - protein, 10 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Asp, Glu, Phe, Gly, His, Ile, Lys, Met, Asn, Pro, Gln, Ser, Thr, Trp, or Tyr
  MISC_FEATURE (4)..(4): Xaa can be Ala, Asp, Glu, Phe, His, Lys, Leu, Met, Pro, Gln, Ser, Thr, Val, Trp, or Tyr
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa is Arg
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, His, Ile, Lys, Leu, Met, Asn, Pro, Gln, Arg, Ser, Thr, Val, Trp, or Ty r
  MISC_FEATURE (9)..(9): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (10)..(10): Xaa can be Ala, Asp, Glu, Phe, Gly, Ile, Lys, Asn, Thr, or Trp
XXXXXXXXXX

SEQ ID NO: 1070 - protein, 10 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Gly, Ile, Pro, Gln, Ser, or Tyr
  MISC_FEATURE (4)..(4): Xaa can be Lys, or Thr
  MISC_FEATURE (5)..(5): Xaa is Gly
  MISC_FEATURE (6)..(6): Xaa is Arg
  MISC_FEATURE (7)..(7): Xaa is Ser
  MISC_FEATURE (8)..(8): Xaa is Ala
  MISC_FEATURE (9)..(9): Xaa can be His, Ile, or Val
  MISC_FEATURE (10)..(10): Xaa can be His, Val, or Tyr
XXXXXXXXXX

SEQ ID NO: 1071 - protein, 10 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa is Tyr
  MISC_FEATURE (4)..(4): Xaa can be Ser, or Thr
  MISC_FEATURE (5)..(5): Xaa is Gly
  MISC_FEATURE (6)..(6): Xaa is Arg
  MISC_FEATURE (7)..(7): Xaa is Ser
  MISC_FEATURE (8)..(8): Xaa can be Ala, or Glu
  MISC_FEATURE (9)..(9): Xaa can be Asn, or Val
  MISC_FEATURE (10)..(10): Xaa can be His, Pro, Val, or Tyr
XXXXXXXXXX

SEQ ID NO: 1072 - protein, 11 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Asp, Glu, Phe, Gly, His, Ile, Lys, Met, Asn, Pro, Gln, Ser, Thr, Trp, or Tyr
  MISC_FEATURE (4)..(4): Xaa can be Ala, Asp, Glu, Phe, His, Lys, Leu, Met, Pro, Gln, Ser, Thr, Val, Trp, or Tyr
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa is Arg
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, His, Ile, Lys, Leu, Met, Asn, Pro, Gln, Arg, Ser, Thr, Val, Trp, or Ty r
  MISC_FEATURE (9)..(9): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (10)..(10): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (11)..(11): Xaa can be Ala, Gly, His, Ile, Leu, or Arg
XXXXXXXXXXX

SEQ ID NO: 1073 - protein, 11 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Glu, Phe, Gly, His, Lys, Met, Asn, Pro, Gln, Trp, or Tyr
  MISC_FEATURE (4)..(4): Xaa can be Ala, Asp, Glu, Phe, His, Lys, Leu, Met, Pro, Gln, Ser, Thr, Val, Trp, or Tyr
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa is Arg
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, His, Ile, Lys, Leu, Met, Asn, Pro, Gln, Arg, Ser, Thr, Val, Trp, or Ty r
  MISC_FEATURE (9)..(9): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (10)..(10): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (11)..(11): Xaa can be Ala, Gly, His, Ile, Leu, or Arg
XXXXXXXXXXX

SEQ ID NO: 1074 - protein, 11 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Asp, Glu, Phe, Gly, His, Ile, Lys, Met, Asn, Pro, Gln, Ser, Thr, Trp, or Tyr
  MISC_FEATURE (4)..(4): Xaa can be Ala, Asp, Phe, Leu, Met, Pro, Gln, Val, Trp, or Tyr
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa is Arg
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, His, Ile, Lys, Leu, Met, Asn, Pro, Gln, Arg, Ser, Thr, Val, Trp, or Ty r
  MISC_FEATURE (9)..(9): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (10)..(10): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (11)..(11): Xaa can be Ala, Gly, His, Ile, Leu, or Arg
XXXXXXXXXXX

SEQ ID NO: 1075 - protein, 11 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Asp, Glu, Phe, Gly, His, Ile, Lys, Met, Asn, Pro, Gln, Ser, Thr, Trp, or Tyr
  MISC_FEATURE (4)..(4): Xaa can be Ala, Asp, Glu, Phe, His, Lys, Leu, Met, Pro, Gln, Ser, Thr, Val, Trp, or Tyr
  MISC_FEATURE (5)..(5): Xaa can be Ala, Glu, Phe, His, Ile, Lys, Leu, Met, Asn, Pro, Gln, Arg, Thr, Val, Trp, or Tyr
  MISC_FEATURE (6)..(6): Xaa is Arg
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, His, Ile, Lys, Leu, Met, Asn, Pro, Gln, Arg, Ser, Thr, Val, Trp, or Ty r
  MISC_FEATURE (9)..(9): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (10)..(10): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (11)..(11): Xaa can be Ala, Gly, His, Ile, Leu, or Arg
XXXXXXXXXXX

SEQ ID NO: 1076 - protein, 11 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Asp, Glu, Phe, Gly, His, Ile, Lys, Met, Asn, Pro, Gln, Ser, Thr, Trp, or Tyr
  MISC_FEATURE (4)..(4): Xaa can be Ala, Asp, Glu, Phe, His, Lys, Leu, Met, Pro, Gln, Ser, Thr, Val, Trp, or Tyr X3
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa is Arg
  MISC_FEATURE (7)..(7): Xaa can be Ala, Asp, Glu, Gly, His, Ile, Lys, Leu, Met, Asn, Gln, Arg, Thr, Val, Trp, or Tyr
  MISC_FEATURE (8)..(8): Xaa can be Ala, Asp, Glu, Phe, His, Ile, Lys, Leu, Met, Asn, Pro, Gln, Arg, Ser, Thr, Val, Trp, or Ty r
  MISC_FEATURE (9)..(9): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (10)..(10): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (11)..(11): Xaa can be Ala, Gly, His, Ile, Leu, or Arg
XXXXXXXXXXX

SEQ ID NO: 1077 - protein, 11 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Asp, Glu, Phe, Gly, His, Ile, Lys, Met, Asn, Pro, Gln, Ser, Thr, Trp, or Tyr X2
  MISC_FEATURE (4)..(4): Xaa can be Ala, Asp, Glu, Phe, His, Lys, Leu, Met, Pro, Gln, Ser, Thr, Val, Trp, or Tyr
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa is Arg
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Glu, Phe, Lys, Met, Asn, Pro, Gln, Arg, Ser, or Trp
  MISC_FEATURE (9)..(9): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (10)..(10): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (11)..(11): Xaa can be Ala, Gly, His, Ile, Leu, or Arg
XXXXXXXXXXX

SEQ ID NO: 1078 - protein, 11 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Asp, Glu, Phe, Gly, His, Ile, Lys, Met, Asn, Pro, Gln, Ser, Thr, Trp, or Tyr
  MISC_FEATURE (4)..(4): Xaa can be Ala, Asp, Glu, Phe, His, Lys, Leu, Met, Pro, Gln, Ser, Thr, Val, Trp, or Tyr
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa is Arg
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, His, Ile, Lys, Leu, Met, Asn, Pro, Gln, Arg, Ser, Thr, Val, Trp, or Ty r
  MISC_FEATURE (9)..(9): Xaa can be Ala, Asp, Phe, Gly, Leu, Met, Pro, Gln, Val, or Trp
  MISC_FEATURE (10)..(10): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (11)..(11): Xaa can be Ala, Gly, His, Ile, Leu, or Arg
XXXXXXXXXXX

SEQ ID NO: 1079 - protein, 11 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Asp, Glu, Phe, Gly, His, Ile, Lys, Met, Asn, Pro, Gln, Ser, Thr, Trp, or Tyr
  MISC_FEATURE (4)..(4): Xaa can be Ala, Asp, Glu, Phe, His, Lys, Leu, Met, Pro, Gln, Ser, Thr, Val, Trp, or Tyr
  MISC_FEATURE (5)..(5): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (6)..(6): Xaa is Arg
  MISC_FEATURE (7)..(7): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (8)..(8): Xaa can be Ala, Asp, Glu, Phe, His, Ile, Lys, Leu, Met, Asn, Pro, Gln, Arg, Ser, Thr, Val, Trp, or Ty r
  MISC_FEATURE (9)..(9): Xaa can be Ala, Asp, Glu, Phe, Gly, His, Ile, Lys, Leu, Met, Asn, Pro, Gln, Arg, Ser, Thr, Val, Trp, or Tyr
  MISC_FEATURE (10)..(10): Xaa can be Ala, Asp, Glu, Phe, Gly, Ile, Lys, Asn, Thr, or Trp
  MISC_FEATURE (11)..(11): Xaa can be Ala, Gly, His, Ile, Leu, or Arg
XXXXXXXXXXX

SEQ ID NO: 1080 - protein, 11 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa can be Ala, Gly, Ile, Pro, Gln, Ser, or Tyr
  MISC_FEATURE (4)..(4): Xaa can be Lys, or Thr
  MISC_FEATURE (5)..(5): Xaa is Gly
  MISC_FEATURE (6)..(6): Xaa is Arg
  MISC_FEATURE (7)..(7): Xaa is Ser
  MISC_FEATURE (8)..(8): Xaa is Ala
  MISC_FEATURE (9)..(9): Xaa can be His, Ile, or Val
  MISC_FEATURE (10)..(10): Xaa can be His, Val, or Tyr
  MISC_FEATURE (11)..(11): Xaa can be Ala, Gly, His, Ile, Leu, or Arg
XXXXXXXXXXX

SEQ ID NO: 1081 - protein, 11 aa, Artificial sequence
  Recombinant polypeptide
  MISC_FEATURE (1)..(1): Xaa can be Ile, Thr, or Tyr
  MISC_FEATURE (2)..(2): Xaa is Ser
  MISC_FEATURE (3)..(3): Xaa is Tyr
  MISC_FEATURE (4)..(4): Xaa can be Ser, or Thr
  MISC_FEATURE (5)..(5): Xaa is Gly
  MISC_FEATURE (6)..(6): Xaa is Arg
  MISC_FEATURE (7)..(7): Xaa is Ser
  MISC_FEATURE (8)..(8): Xaa can be Ala, or Glu
  MISC_FEATURE (9)..(9): Xaa can be Asn, or Val
  MISC_FEATURE (10)..(10): Xaa can be His, Pro, Val, or Tyr
  MISC_FEATURE (11)..(11): Xaa can be Ala, Gly, His, Ile, Leu, or Arg
XXXXXXXXXXX

SEQ ID NO: 1082 - protein, 28 aa, Artificial sequence
  an artificially synthesized sequence
TVSSASSGGSGLSGRSDNHGSSGGTKGP

SEQ ID NO: 1083 - protein, 19 aa, Artificial sequence
  an artificially synthesized sequence
TVLSGRSDNHGSSASTKGP

SEQ ID NO: 1084 - protein, 28 aa, Artificial sequence
  an artificially synthesized sequence
TVSGGSGLSGRSDNHGSSGGSSASTKGP

SEQ ID NO: 1085 - protein, 19 aa, Artificial sequence
  an artificially synthesized sequence
TVSSASTKLSGRSDNHGGP

SEQ ID NO: 1086 - protein, 28 aa, Artificial sequence
  an artificially synthesized sequence
TVSSASTKSGGSGLSGRSDNHGSSGGGP

SEQ ID NO: 1087 - protein, 11 aa, Artificial sequence
  an artificially synthesized sequence
VEIKRTVAAPS

SEQ ID NO: 1088 - protein, 18 aa, Artificial sequence
  an artificially synthesized sequence
TVSSASLSGRSDNHTKGP

SEQ ID NO: 1089 - protein, 4 aa, Artificial sequence
  an artificially synthesized sequence
LSGR

SEQ ID NO: 1090 - protein, 4 aa, Artificial sequence
  an artificially synthesized sequence
SDNH

The invention claimed is:

1. A polypeptide comprising an antigen-binding domain and a carrying moiety, wherein the carrying moiety has an inhibiting domain that inhibits the antigen-binding activity of the antigen-binding domain, wherein the polypeptide has a protease cleavage sequence comprising one or a plurality of sequences selected from the sequences of SEQ ID NOs: 168-177, wherein the antigen-binding domain comprises a single-domain antibody and has a shorter half-life in blood than the carrying moiety.

2. The polypeptide of claim 1, wherein inhibition of antigen-binding activity of the antigen-binding domain by the inhibiting domain in a state where the protease cleavage sequence has been cleaved by a protease is weaker than the inhibition of antigen-binding activity of the antigen-binding domain by the inhibiting domain in a state where the protease cleavage sequence is uncleaved.

3. The polypeptide of claim 1, wherein the antigen-binding domain is capable of being released from the polypeptide, and wherein the antigen-binding domain has higher antigen-binding activity in a state where it is released from the polypeptide than antigen-binding activity in a state where it is not released from the polypeptide.

4. The polypeptide of claim 1, wherein the antigen-binding activity of the antigen-binding domain is inhibited by the association of the inhibiting domain of the carrying moiety with the antigen-binding domain.

5. The polypeptide of claim 3, wherein the protease cleavage sequence is cleaved by a protease, so that the antigen-binding domain becomes capable of being released from the polypeptide or/and so that the association of the inhibiting domain of the carrying moiety with the antigen-binding domain is canceled.

6. The polypeptide of claim 1, wherein the protease is a cancer tissue specific protease or an inflammatory tissue specific protease.

7. The polypeptide of claim 1, wherein the antigen-binding domain comprises a single-domain antibody, wherein the inhibiting domain of the carrying moiety is a VHH, an antibody VH, or an antibody VL, and wherein the antigen-binding activity of the single-domain antibody is inhibited by the VHH, the antibody VH, or the antibody VL.

8. The polypeptide of claim 1, wherein the carrying moiety comprises an antibody constant region.

9. The polypeptide of claim 8, wherein the N terminus of the antibody constant region of the carrying moiety and the C terminus of the antigen-binding domain are fused via a linker or without a linker, and wherein the protease cleavage sequence is located near the boundary between the antigen-binding domain and the antibody constant region.

10. The polypeptide of claim 8, wherein the antibody constant region of the polypeptide is an IgG antibody constant region.

11. The polypeptide of claim 1, wherein the polypeptide is an IgG antibody-like molecule.

12. A pharmaceutical composition comprising the polypeptide of claim 1.

13. A method for producing the polypeptide of claim 1.

14. The polypeptide claim 7, wherein the carrying moiety comprises an antibody constant region.

15. The polypeptide of claim 14, wherein the N terminus of the antibody constant region of the carrying moiety and the C terminus of the antigen-binding domain are fused via a linker or without a linker, and wherein the protease cleavage sequence is located near the boundary between the antigen-binding domain and the antibody constant region.

16. The polypeptide of claim 15, wherein the antibody constant region of the polypeptide is an IgG antibody constant region.

17. A pharmaceutical composition comprising the polypeptide of claim 16.

18. A method for producing the polypeptide of claim 15.

19. A polynucleotide or set of polynucleotides encoding the polypeptide of claim 1.

* * * * *